US012600958B2

(12) United States Patent
Xu et al.

(10) Patent No.: US 12,600,958 B2
(45) Date of Patent: Apr. 14, 2026

(54) METHODS AND COMPOSITIONS FOR MANUFACTURING POLYNUCLEOTIDES

(71) Applicant: PRIMROSE BIO, INC., San Diego, CA (US)

(72) Inventors: Dongxin Karen Xu, San Diego, CA (US); Kadir Chir Tung, Poway, CA (US); Sabrina Baffert, San Diego, CA (US); Alan Greener, San Diego, CA (US); Helge Zieler, San Diego, CA (US)

(73) Assignee: PRIMROSE BIO, INC., San Diego, CA (US)

( * ) Notice: Subject to any disclaimer, the term of this patent is extended or adjusted under 35 U.S.C. 154(b) by 1145 days.

(21) Appl. No.: 17/614,286

(22) PCT Filed: May 23, 2020

(86) PCT No.: PCT/US2020/034433

§ 371 (c)(1),
(2) Date: Nov. 24, 2021

(87) PCT Pub. No.: WO2020/243026

PCT Pub. Date: Dec. 3, 2020

(65) Prior Publication Data

US 2023/0076421 A1 Mar. 9, 2023

Related U.S. Application Data

(60) Provisional application No. 62/852,613, filed on May 24, 2019.

(51) Int. Cl.

| | |
|---|---|
| ***C12N 9/12*** | (2006.01) |
| ***C12N 15/63*** | (2006.01) |
| ***C12P 19/34*** | (2006.01) |
| ***C12Q 1/6865*** | (2018.01) |

(52) U.S. Cl.

CPC ............ *C12N 9/1247* (2013.01); *C12P 19/34* (2013.01); *C12Q 1/6865* (2013.01); *C12Y 207/07006* (2013.01)

(58) Field of Classification Search

CPC ....... C12N 15/63; C12N 9/1247; C12P 19/34; C12Q 1/6865; C12Q 2525/143; C12Q 2531/143; C12Y 207/07006

See application file for complete search history.

(56) References Cited

U.S. PATENT DOCUMENTS

| | | | | |
|---|---|---|---|---|
| 5,849,546 | A | 12/1998 | Sousa et al. | |
| 7,335,471 | B2 | 2/2008 | Guillerez et al. | |
| 2013/0224793 | A1 | 8/2013 | Martin et al. | |
| 2016/0312260 | A1* | 10/2016 | Zhu | ................ C12Y 207/07006 |
| 2018/0016614 | A1 | 1/2018 | Jewett et al. | |

FOREIGN PATENT DOCUMENTS

| | | | |
|---|---|---|---|
| CN | 105779488 | A | 7/2016 |
| FR | 2822164 | A1 | 9/2002 |
| WO | 2001066705 | A1 | 9/2001 |
| WO | WO 2015024017 | A2 | 2/2015 |
| WO | 2015024017 | A3 | 4/2015 |
| WO | WO 2017123748 | A1 | 7/2017 |
| WO | WO 2019036682 | A1 | 2/2019 |

OTHER PUBLICATIONS

Seed, K. D. et al (2011). Evidence of a dominant lineage of Vibrio cholerae-specific lytic bacteriophages shed by cholera patients over a 10-year period in Dhaka, Bangladesh. mBio, 2(1), e00334-10. https://doi.org/10.1128/mBio.00334-10. printed as p. 1/9-9/9 and p. 1/1 of supplementary material. (Year: 2011).*

International Search Report for PCT Application No. PCT/US2020/034433—Sep. 14, 2020.

Kajsik, M et al, "Characterization of Dev-CD-23823 and Dev-CT57, new Autographivirinae bacteriophages infecting *Cronobacter* spp." Archives of Virology (2019) vol. 164, pp. 1383-1391.

Leon-Verlarde, C., "The Application of Bacteriophage Host Recognition Binding Proteins for the Isolation of Yersinia enterocolitica in Foods.", a Thesis presented to the University of Guelph, (2017), in partial fulfilment of requirements for the degree of Doctor in Philosophy in Food Science.

Losick, R., In Vitro Transcription, Harvard University, Annual Review Biochem, 1972, vol. 19, pp. 409-440.

Arai R et al, "Design of the linkers which effectively separate domains of a bifunctional fusion protein." Protein Engineering 14, 2001, vol. 8, pp. 529-532.

Bagdasarian, M et al, "Specific-purpose plasmid cloning vectors. II. Broad host range, high copy number, RSF1010-derived vectors, and a host-vector system for gene cloning in Pseudomonas." Gene 16, 1981, vols. 1-3, pp. 237-247.

Burnett, JC et al, "Current progress of siRNA/shRNA therapeutics in clinical trials." Biotechnol J. 6, 2011, vol. 9, pp. 1130-1146.

Chang, AC and Cohen, SN, "Construction and characterization of amplifiable multicopy DNA cloning vehicles derived from the P15A cryptic miniplasmid." J Bacteriol. 134, 1978, vol. 3 pp. 1141-1156.

Chellyserrykattil and Ellington, "Evolution of a T7 RNA polymerase variant that transcribes 2'-0-methyl RNA", Nat Biotechnol, 2004, vol. 22, 9, pp. 1155-1160.

Ge Q, et al, "Effects of chemical modification on the potency, serum stability, and immunostimulatory properties of short shRNAs." RNA 16, 2010, vol. 1, pp. 118-130.

Gholamalipour, Y, et al (2018). "3' end additions by T7 RNA polymerase are RNA self-templated, distributive and diverse in character—RNA-Seq analyses." Nucleic Acids Res.;46(18):9253-9263.

(Continued)

*Primary Examiner* — Jennifer Dunston
*Assistant Examiner* — Alexandra Rose Lippolis
(74) *Attorney, Agent, or Firm* — JONES DAY

(57) ABSTRACT

The present disclosure provides compositions and methods for polynucleotide synthesis in vitro, specifically the use of single-subunit RNA polymerases for synthesis and manufacturing of RNA.

9 Claims, 1 Drawing Sheet

Specification includes a Sequence Listing.

(56) References Cited

OTHER PUBLICATIONS

Gibson, DG et al, "Chemical synthesis of the mouse mitochondrial genome." Nat Methods. 2010, vol. 7(11), pp. 901-903.
Gibson, DG et al, Enzymatic assembly of DNA molecules up to several hundred kilobases. Nat Methods., 2009, vol. 6(5), pp. 343-345.
Ibach, J et al, "Identification of a T7 RNA polymerase variant that permits the enzymatic synthesis of fully 2'-O-methyl-modified RNA." J Biotechnol. 2013, vol. 167(3), pp. 287-295.
Irwin, CR et al, "In-fusion® cloning with vaccinia virus DNA polymerase." Methods Mol Biol. 2012, vol. 890, pp. 23-35.
Jackson, AL et al, "Position-specific chemical modification of siRNAs reduces "off-target" transcript silencing." RNA 2006, vol. 12(7), pp. 1197-1205.
Jeong, J et al, "Genome-scale genetic engineering in *Escherichia coli*." Biotechnol Adv., 2013, vol. 31(6), pp. 804-810.
Kole, R et al, "RNA therapeutics: beyond RNA interference and antisense oligonucleotides." Nat Rev Drug Discov., 2012, vol. 11(2), pp. 125-140.
Kraynack, BA and Baker, BF "Small interfering RNAs containing full 2'-O-methylribonucleotide-modified sense strands display Argonaute2/eIF2C2-dependent activity." RNA, 2005, vol. 12(1, pp. 163-176.
Lathe, R et al, "Linker tailing: unphosphorylated linker oligonucleotides for joining DNA termini." DNA, 1984, vol. 3 (2), pp. 173-182.
Layzer, JM et al, "In vivo activity of nuclease-resistant siRNAs." RNA, 2004, vol. 10(5), pp. 766-771.
Leprince, A et al, "Streamlining genomes: toward the generation of simplified and stabilized microbial systems." Curr Opin Biotechnol., 2012, vol. 23(5), pp. 651-658.
Li, C et al, "FastCloning: a highly simplified, purification-free, sequence- and ligation-independent PCR cloning method." BMC Biotechnol. 2011, vol. 11, p. 92.
Li, MZ and Elledge, SJ, "Harnessing homologous recombination in vitro to generate recombinant DNA via SLIC." Nat Methods., 2007, vol. 4(3), pp. 251-256.
Li, MZ and Elledge, SJ. "SLIC: a method for sequence- and ligation-independent cloning." Methods Mol Biol. 2012, vol. 852, pp. 51-59.
Lobban, PE and Kaiser, AD, "Enzymatic end-to end joining of DNA molecules." J Mol Biol. 1973, vol. 78(3), pp. 453-471.
Madyagol, M et al, "Gene replacement techniques for *Escherichia coli* genome modification." Folia Microbiol (Praha) 2011, vol. 56(3), pp. 253-263.
Majilessi, M et al, "Advantages of 2'-O-methyl oligoribonucleotide probes for detecting RNA targets." Nucleic Acids Res. 1998, vol. 26(9), pp. 2224-2229.
Meyer, AJ et al, "Transcription yield of fully 2'-modified RNA can be increased by the addition of thermostabilizing mutations to T7 RNA polymerase mutants." Nucleic Acids Res. 2015, vol. 43(15), pp. 7480-7488.
Meyer, R et al, "Molecular vehicle properties of the broad host range plasmid RK2." Science 1975, vol. 190(4220), pp. 1226-1228.
Monsion, B et al, "Efficient detection of long dsRNA in vitro and in vivo using the dsRNA binding domain from FHV B2 Protein." Front Plant Sci. 2018, vol. 9, p. 70.
Mu, X et al, "An origin of the immunogenicity of in vitro transcribed RNA." Nucleic Acids Res. 2018, vol. 46(10), pp. 5239-5249.
Padilla, R and Sousa, R, "RNA polymerase double mutant displays superior properties for synthesizing RNAs with non-canonical NTPs." Nucleic Acids Res. 2002, vol. 30(24) p. e138.
Quan, J and Tian, J, "Circular polymerase extension cloning for high-throughput cloning of complex and combinatorial DNA libraries." Nat Protoc. 2011, vol. 6(2), pp. 242-251.
Quan, J and Tian, J, "Circular polymerase extension cloning of complex gene libraries and pathways" PLoS One. 2009, vol. 4(7): p. e6441.
Regalado, A , "The Next Great GMO Debate." MIT Technology Review. 2015. https://www.technologyreview.com/2015/08/11/166550/the-next-great-gmo-debate.
Richter, K and Gescher, J "The molecular toolbox for chromosomal heterologous multiprotein expression in *Escherichia coli*." Biochem Soc Trans. 2012, vol. 40(6), pp. 1222-1226.
Rose, RE, "The nucleotide sequence of pACYC184." Nucleic Acids Res. 1988, vol. 16(1), p. 355.
Rossbach, M, "Small non-coding RNAs as novel therapeutics." Curr Mol Med. 2010, vol. 10(4), pp. 361-368.
Sahin, U et al, "mRNA-based therapeutics-developing a new class of drugs." Nat Rev Drug Discov. 2014, vol. 13 (10), pp. 759-780.
Sambrook, J et al, 1989) "Molecular Cloning: A Laboratory Manual." 1989 Second Ed., Cold Spring Harbor Laboratory Press, Plainview, New York.
Schmidhauser, TJ and Helinski, DR (1985). "Regions of broad-host-range plasmid RK2 involved in replication and stable maintenance in nine species of gram-negative bacteria." J Bacteriol. 1985, vol. 164(1), pp. 446-455.
Schmidhauser, TJ et al, "Replication of derivatives of the broad host range plasmid RK2 in two distantly related bacteria." Plasmid 1983, vol. 9(3), pp. 325-330.
Schweizer, H "Bacterial genetics: past achievements, present state of the field, and future challenges." Biotechniques 2008, vol. 44(5), pp. 633-641.
Sergeeva, OV et al, "mRNA-Based Therapeutics—Advances and Perspectives." Biochemistry (Mosc) 2016, vol. 81 (7), pp. 709-722.
Shizuya, H et al, "Cloning and stable maintenance of 300-kilobase-pair fragments of human DNA in *Escherichia coli* using an F-factor-based vector." Proc Natl Acad Sci U S A. 1992, vol. 89(18), pp. 8794-8797.
Siegmund, V et al, "Screening mutant libraries of T7 RNA polymerase for candidates with increased acceptance of 2'-modified nucleotides." Chem Commun (Camb). 2012, vol. 48(79), pp. 9870-9872.
Son, KN et al, "Double-stranded RNA Is detected by immunofluorescence analysis in RNA and DNA virus infections, including those by negative-stranded RNA viruses." J Virol. 2015, vol. 89(18), pp. 9383-9392.
Thieme, F et al, "Quick and clean cloning: a ligation-independent cloning strategy for selective cloning of specific PCR products from non-specific mixes." PLoS One 2011, vol. 6(6), pp. e20556.
Tsygankov, YD and Chistoserdov, AY, "Specific-purpose broad-host-range vectors." Plasmid 1985, vol. 14(2), pp. 118-125.
Vroom, JA and Wang, CL, Modular construction of plasmids through ligation-free assembly of vector components with oligonucleotide linkers.: Biotechniques 2008, vol. 44(7), pp. 924-926.
Wang, R et al, (2010). "Enhancement of engineered trifunctional enzyme by optimizing linker peptides for degradation of agricultural by-products." Enzyme and Microb. Technol. 2010, vol. 47 (5), pp. 194-199.
Weber, F et al, "Double-stranded RNA is produced by positive-strand RNA viruses and DNA viruses but not in detectable amounts by negative-strand RNA viruses." J Virol. 2006, vol. 80(10), pp. 5059-5064.
Wilson, C and Keefe, AD, "Building oligonucleotide therapeutics using non-natural chemistries." Curr Opin Chem Biol. 2006, vol. 10(6), pp. 607-614.
Chen et al., 2016, "Isolation, genome sequencing and functional analysis of two T7-like coliphages of avian pathogenic *Escherichia coli*," Gene, 582(1):47-58.
GenBank Accession No. ACR16468.1, "RNA polymerase [Vibrio phage N4]," May 17, 2012 (2 pages).
GenBank Accession No. ACY66666.1, "T3/T7-like RNA polymerase [Klebsiella phage KP32]," Nov. 10, 2009 (2 pages).
GenBank Accession No. AKG94487.1, "DNA-directed RNA polymerase [Delftia phage IME-DE1]," May 16, 2015 (2 pages).
GenBank Accession No. BAO20676.1, "putative RNA polymerase [Pseudomonas phage PPpW-4]," May 7, 2016 (2 pages).
International Searching Authority, International Search Report and Written Opinion for International Patent Application No. PCT/US2020/034433 (Pub No. WO 2020243026) mailed Sep. 14, 2020 (17 pages).

(56) References Cited

OTHER PUBLICATIONS

Kawato et al., 2015, "Complete genome sequence analysis of two Pseudomonas plecoglossicida phages, potential therapeutic agents," Appl. Environ. Microbiol., 81(3):874-881 (Epub 2014).
Liu et al., 2014, "Genome sequences characterizing five mutations in RNA polymerase and major capsid of phages ϕA318 and ϕAs51 of Vibrio alginolyticus with different burst efficiencies," BMC Genomics, 15(1):505.
Liu et al., 2016, "The complete genome sequence of PE3-1, a novel *E. coli* O153 phage," Arch. Virol., 161(11):3291-3294.
Losick, 1972, "In vitro transcription," Annu Rev Biochem., 41:409-446.
Scholl et al., 2005, "The genome of bacteriophage K1F, a T7-like phage that has acquired the ability to replicate on K1 strains of *Escherichia coli*," J. Bacteriol., 187(24):8499-8503.
Zhu et al., 2010, "Identification of lytic bacteriophage MmP1, assigned to a new member of T7-like phages infecting Morganella morganii," Genomics, 96(3):167-172.
Yanisch-Perron, C et al, "Improved M13 phage cloning vectors and host strains: nucleotide sequences of the M13mp18 and pUC19 vectors." Gene 1985, vol. 33(1), pp. 03-119.
Zhu, B et al, "In-fusion assembly: seamless engineering of multidomain fusion proteins, modular vectors, and mutations." BioTechniques 2007, vol. 43, pp. 354-359.
Andries, Oliwia et al, "N1-methylpseudouridine-incorporated mRNA outperforms pseudouridine-incorporated mRNA by providing enhanced protein expression and reduced immunogenicity in mammalian cell lines and mice", Journal of Controlled Release, 2015, vol. 217, pp. 337-344.
Butler, ET and Chamberlin, MJ, "Bacteriophage SP6-specific RNA polymerase. I. Isolation and characterization of the enzyme." J Biol Chem. 257, 1982, vol. 10, pp. 5772-5778.
Darzynkiewicz, E, et al, "Beta-globin mRNAs capped with m7G, m2.7(2)G or m2.2.7(3)G differ in intrinsic translation efficiency." Nucleic Acids Res. 1988, vol. 16(18), pp. 8953-8962.
Imburgio, D et al, "Studies of promoter recognition and start site selection by T7 RNA polymerase using a comprehensive collection of promoter variants." Biochemistry 2000, vol. 39(34), pp. 10419-10430.
Kariko, K et al, "Incorporation of pseudouridine into mRNA yields superior nonimmunogenic vector with increased translational capacity and biological stability." Mol Ther. 2008. vol. 16(11), pp. 1833-1840.
Konarska., MM et al, "Recognition of cap structure in splicing in vitro of mRNA precursors." Cell, 1984, vol. 38(3), pp. 731-736.
Mcgraw, NJ et al, "Sequence and analysis of the gene for bacteriophage T3 RNA polymerase." Nucleic Acids Res. 1985, vol. 13(18), pp. 6753-6766.
Pardi, N et al, "Nucleoside Modified mRNA Vaccines for Infectious Diseases." In Springer Protocols, Methods in Molecular Biology 1499; RNA Vaccines Methods and Protocols (Springer Science + Business Media New York 2017), Chapter 6, pp. 109-122.
Pasquinelli, AE et al, "Reverse 5' caps in RNAs made in vitro by phage RNA polymerases." RNA 1995, vol. 1(9), pp. 957-967.
Potapov, V et al, "Base modifications affecting RNA polymerase and reverse transcriptase fidelity." Nucleic Acids Res. 2018, vol. 46(11), pp. 5753-5763.
Schonborn, J et al, "Monoclonal antibodies to double-stranded RNA as probes of RNA structure in crude nucleic acid extracts." Nucleic Acids Res. 1991, vol. 19(11), pp. 2993-3000.
Stepinski, J et al, "Synthesis and properties of mRNAs containing the novel "anti-reverse" cap analogs 7-methyl(3'-O-methyl)GpppG and 7-methyl (3'-deoxy)GpppG." RNA 2001, vol. 7(10), pp. 1486-1495.
Studier, FW and Moffatt, BA "Use of bacteriophage T7 RNA polymerase to direct selective high-level expression of cloned genes." J Mol Biol. 1986, vol. 189(1), pp. 113-130.
Zangger, H, et al, "Detection of Leishmania RNA virus in Leishmania parasites." PLoS Negl Trop Dis. 2013, vol. 7(1), p. e2006.
Zhu B et al, "Syn5 RNA polymerase synthesizes precise run-off RNA products." Nucleic Acids Res. 2014, vol. 42(5), e33, pp. 1-10.
Zhu, B et al, "The RNA polymerase of marine cyanophage Syn5." J Biol Chem. 2013, vol. 288(5), pp. 3545-3552.
GenBank Accession No. ADX87591.1, T3/T7-like RNA polymerase [Vibrio pha ge ICP3_2008_A], Jul. 7, 2011 (2 pages).
GenBank Accession No. HQ641343.1, Vibrio phage ICP3_2008_A, complete genome, Jul. 7, 2011 (29 pages).

* cited by examiner

METHODS AND COMPOSITIONS FOR MANUFACTURING POLYNUCLEOTIDES

This application is the National Stage Under 35 U.S.C. § 371 of PCT International Application No. PCT/US2020/034433 filed on May 23, 2020, which claims priority under 35 U.S.C. § 119(e) on U.S. Provisional Application No. 62/852,613 filed on May 24, 2019, the entire contents of each of which are hereby incorporated by reference.

INCORPORATION OF SEQUENCE LISTING

The content of the electronically submitted sequence listing in ASCII text file named Jun. 6, 2022_PG0016_Substitute Sequence_Listing_ST25 which is approximately 716 KB in size, was created on Jun. 2, 2022 and electronically submitted via EFS-Web on Jun. 21, 2022 and is hereby incorporated by reference in its entirety.

BACKGROUND

Explorations of RNA as a molecule of clinical and biotechnological utility have increased dramatically in the past decade. For human therapeutic uses, RNA is being developed and used as a carrier of protein-coding information and gene regulatory activity to affect many aspects of human physiology (Rossbach 2010, Burnett 2011, Kole 2012, Sahin 2014, Sergeeva 2016).

In agriculture, the development of spray technology for siRNAs as novel pesticides has led to an explosion of potential crop applications (Regalado 2015).

Despite this promise, commercial development of RNA-based vaccines and therapeutics, as well as RNAs used in agriculture, has been slowed by the difficulty of manufacturing large quantities of commercially suitably material of uniform sequence and length.

Progress in the development of RNA-based vaccines, RNA therapeutics and RNA products for therapeutic and agricultural applications has created an unmet demand for inexpensive and efficient RNA manufacturing methods capable of generating large quantities (g to ktons) of pure, molecularly uniform RNA. Furthermore, many applications are using chemical modifications that serve to increase RNA stability and efficacy. Because RNA is inherently unstable, RNA intended for human uses are chemically modified to stabilize the molecule and extend its shelf life and half-life in the human body (Majlessi 1998, Layzer 2004, Kraynack 2005, Jackson 2006, Wilson 2006, Ge 2010). The simplest way to achieve this is to incorporate non-native nucleotides, for example those blocked at their 2' position, into RNA during manufacture.

The commonly used T7 RNA polymerase and its known variants (Padilla 2002, Chelliserrykattil 2004, Siegmund 2012, Ibach 2013, Meyer 2015) fall far short of the requirements for such a manufacturing process, necessitating the development of novel RNA polymerases that incorporate non-natural nucleotides into RNA efficiently and with high fidelity. Through variations in its structure and/or different delivery mechanisms, RNAs can be designed to affect both systemic and tissue-specific processes, further broadening its utility.

Specific RNA sequences are efficiently generated by in vitro transcription (IVT) from DNA templates using bacteriophage single-subunit RNA polymerases (RNApols). In principle, such reactions can be developed into large-scale manufacturing processes. However, currently available RNApols have several limitations which reduce their suitability for RNA manufacturing: 1) relatively low specific activity which requires long reaction times or high enzyme doses; 2) low efficiencies of incorporating modified nucleotides 3) low RNA quality due to a high percentage of aberrant transcripts (i.e. mutated or truncated), resulting in reduced protein yields and potential off-target effects, and 4) High levels of double-stranded RNA, which is highly immunogenic (Mu 2018, Gholamalipour 2018). The manufacturing challenges associated with therapeutic mRNAs represent a significant hurdle for the clinical development and commercialization of a large number of potentially active RNA vaccines and therapeutics. In attempts to solve this problem, the widely used bacteriophage T7 RNA polymerase (T7 RNApol) has been mutated to improve its incorporation of non-natural nucleotides. Yet even the best available T7 RNApol variants (Padilla 2002, Chelliserrykattil 2004, Siegmund 2012, Ibach 2013, Meyer 2015) show deficiencies in all four of the above-listed performance indicators, and these enzymes fall far short of the requirements of a manufacturing process for clinical material.

A robust solution to the problem of manufacturing large quantities of therapeutic grade RNA requires casting a wider net for RNApols with the desired catalytic activity. The present disclosure describes novel single-subunit RNApols that have desirable properties for RNA manufacturing in vitro.

SUMMARY

We describe 37 new single-subunit RNA polymerases and their promoters that can be used to manufacture RNA in vitro. These enzymes are suited for RNA synthesis and RNA manufacturing by virtue of specific qualities related to RNA length, RNA size distribution, RNA yield, RNA quality, RNA sequence fidelity, absence of double-stranded RNA. These polymerases are also capable of incorporating non-natural nucleotides into RNA. Therefore the single-subunit RNA polymerases disclosed herein are useful for manufacturing pharmaceuticals, medicaments, therapeutics, vaccines, diagnostics and cosmetics as they produce high quality RNA. The single-subunit RNA polymerases disclosed herein also allow more efficient RNA manufacturing at a cost that is significantly reduced, even compared to optimized T7 polymerase manufacturing processes.

BRIEF DESCRIPTION OF THE DRAWINGS

FIG. 1A: 3 μl each of RNAs produced in 20 μl in vitro transcription reactions. Lane identities from left: M: RNA marker; 1: RNA transcribed with RNA polymerase (RNApol) from *Yersinia* phage phiR8-01; 2:1.8kb DNA template; 3: RNA transcribed with RNApol from *Aeromonas* phage phiAS7; 4: RNA transcribed with RNApol from *Caulobacter* phage Percy; 5:1.8kb DNA template; 6: RNA transcribed with RNApol from *Burkholderia* phage Bp-AMP4; 7, 8: RNA transcribed with RNApol from *Pseudomonas* phage *Andromeda;* 9: RNA transcribed with RNApol from *Proteus* phage vB_PmiP_Pm5460; 10: RNA transcribed with RNApol from Delftia phage IME-DE1; 11: RNA transcribed with RNApol from *Vibrio* phage N4; 12: RNA transcribed with RNApol from *Morganella* phage vB_MmoP_MP2; M: RNA marker; 13: RNA transcribed with RNApol from *Xanthomonas* phage f30-Xaj; 14: RNA transcribed with RNApol from *Escherichia* phage T7. The RNA marker is a single-stranded RNA ladder sold by New England Biolabs (Ipswich, MA, USA) containing the following RNA sizes in nucleotides: 500, 1000, 2000, 3000, 5000, 7000, 9000. The migration of the RNAs produced by the RNA polymerases is consistent with a ~1.8kb size of the RNA, corresponding to the ~1.8kb size of the template DNA.

FIG. 1B: 3 μl each of RNAs produced in 20 μl in vitro transcription reactions. Lane identities from left: M: RNA marker; 1:1.8 kb DNA template; 2:1.8 kb DNA template; 3: RNA transcribed with RNApol from *Pantoea* phage LIMElight; 4: RNA transcribed with RNApol from *Salmonella* virus SP6; 5: RNA transcribed with RNApol from *Escherichia* phage ECBP5; 6: RNA transcribed with RNApol from *Kluyvera* phage Kvp1; 7: RNA transcribed with RNApol from *Klebsiella* phage KP32; 8: RNA transcribed with RNApol from *Stenotrophomonas* phage IME15; 9: RNA transcribed with RNApol from *Escherichia* phage T7. The RNA marker is a single-stranded RNA ladder sold by New England Biolabs (Ipswich, MA, USA) containing the following RNA sizes in nucleotides: 500, 1000, 2000, 3000, 5000, 7000, 9000. The migration of the RNAs produced by the RNA polymerases is consistent with a ~1.8kb size of the RNA, corresponding to the ~1.8kb size of the template DNA.

DETAILED DESCRIPTION

Figure 1A:
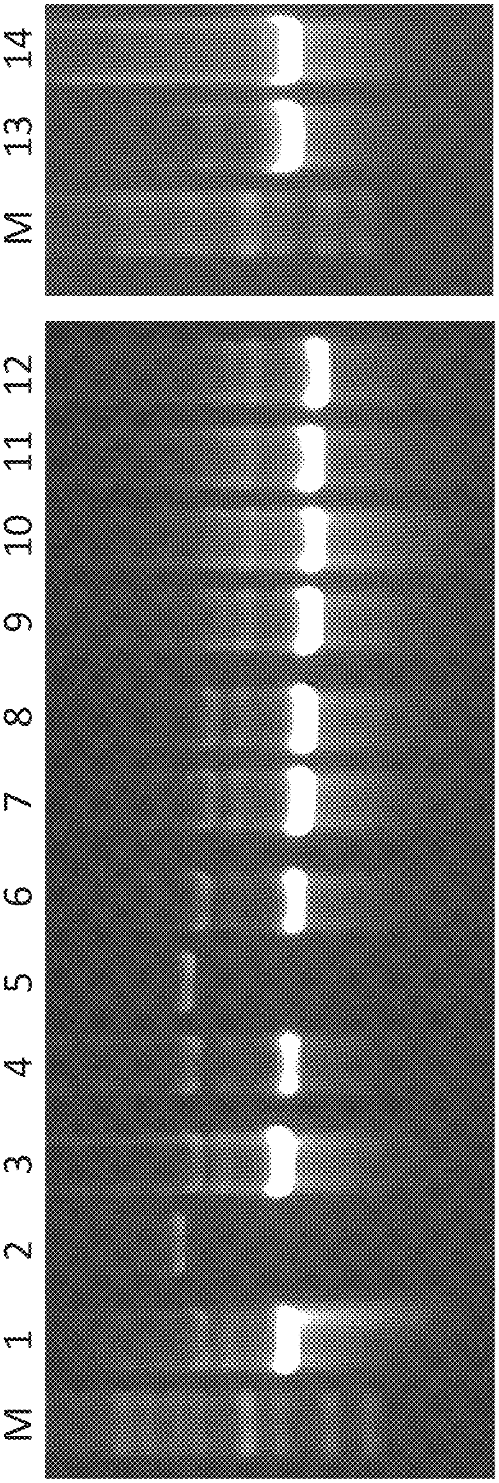
FIG. 1A and FIG. 1B: RNAs produced in vitro and electrophoresed on agarose gels.

The following abbreviations and definitions will be used for the interpretation of the specification and the claims.

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Complementary nucleotide sequence: As used herein, a complementary nucleotide sequence is a sequence in a polynucleotide chain in which all of the bases are able to form base pairs with a sequence of bases in another polynucleotide chain.

Control elements: The term 'control elements' refers to nucleotide sequences located upstream (5' non-coding sequences), within, or downstream (3' non-coding sequences) of a coding sequence and which influence the transcription, RNA processing or stability, or translation of the associated coding sequence. Regulatory sequences include but are not limited to promoters, translation leader sequences, introns, polyadenylation recognition sequences, RNA processing site, effector binding site and stem-loop structure.

Degenerate Sequence: In this application degenerate sequences are defined as populations of sequences where specific sequence positions differ between different molecules or clones in the population. The sequence differences may be a single nucleotide or multiple nucleotides of any number, examples being 2, 3, 4, 5, 6, 7, 8, 9, 10, 20, 30, 40, 50, 60, 70, 80, 90, 100, 200, 300, 400, 500, 600, 700, 800, 900 or 1000 nucleotides, or any number in between. Sequence differences in a degenerate sequence may involve the presence of 2, 3 or 4 different nucleotides in that position within the population of sequences, molecules or clones. Examples of degenerate nucleotides in a specific position of a sequence are: A or C; A or G; A or T; C or G; C or T; G or T; A, C or G; A, C or T; A, G or T; C, G or T; A, C, G or T.

Expression: The term "expression", as used herein, refers to the transcription and stable accumulation of sense (mRNA) or antisense RNA derived from the nucleic acid disclosed, as well as the accumulation of polypeptide as a product of translation of mRNA.

Full-length Open Reading Frame: As used herein, a full-length open reading frame refers to an open reading frame encoding a full-length protein which extends from its natural initiation codon to its natural final amino-acid coding codon, as expressed in a cell or organism. In cases where a particular open reading frame sequence gives rise to multiple distinct full-length proteins expressed within a cell or an organism, each open reading frame within this sequence, encoding one of the multiple distinct proteins, are considered full-length. In different aspects of the disclosure, a full-length open reading frame is either continuous or interrupted by introns.

Gene: The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature in its natural host organism. "Natural gene" refers to a gene complete with its natural control sequences such as a promoter and terminator. "Chimeric gene" refers to any gene that comprises regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. Similarly, a "foreign" gene refers to a gene not normally found in the host organism, but that is introduced into the host organism by gene transfer. Foreign genes include native genes inserted into a non-native organism, or chimeric genes. A "transgene" is a gene that has been introduced into the genome by a transformation procedure.

In-Frame: The term "in-frame" in this application, and particularly in the phrase "in-frame fusion polynucleotide," refers to the reading frame of codons in an upstream or 5' polynucleotide or ORF as being the same as the reading frame of codons in a polynucleotide or ORF placed downstream or 3' of the upstream polynucleotide or ORF that is fused with the upstream or 5' polynucleotide or ORF. Such in-frame fusion polynucleotides encode a fusion protein or fusion peptide encoded by both the 5' polynucleotide and the 3' polynucleotide. In vitro transcription reaction: An "in vitro transcription reaction" as used herein is a reaction designed to produce RNA by transcribing a DNA template in vitro. In vitro transcription reactions contain one or more DNA template molecules encoding the RNAs to be transcribed, one or more completely or partially purified single-subunit RNA polymerases, a minimum of four nucleotide triphosphates as substrates for the single-subunit RNA polymerase(s), buffers, divalent cations and salts as necessary for the reaction.

Iterate/Iterative: In this application, to iterate means to apply a method or procedure repeatedly to a material or sample. Typically, the processed, altered or modified material or sample produced from each round of processing, alteration or modification is then used as the starting material for the next round of processing, alteration or modification. Iterative selection refers to a selection process that iterates or repeats the selection two or more times, using the survivors of one round of selection as starting material for the subsequent rounds.

Linker sequence refers to a polynucleotide sequence or polypeptide sequence separating two polynucleotides or polypeptides in a fusion polynucleotide or fusion polypeptide. For example, a fusion polynucleotide contains two or more ORFs that are separated by a linker sequence, which encodes a peptide which separates the two parts of the polypeptide that results from expression and translation of the fusion polynucleotide. A linker can also separate an epitope tag from a protein or enzyme. Linker sequences can have diverse length or sequence composition.

Non-homologous: The term "non-homologous" in this application is defined as having sequence identity at the nucleotide level of less than 50%.

Nucleotide triphosphates: "Nucleotide triphosphates" in this application is defined as any of the ribonucleotide triphosphates ATP, CTP, GTP and UTP used in RNA synthesis, or any modified analogs, derivatives or variants thereof.

Open Reading Frame (ORF): An ORF is defined as any sequence of nucleotides in a nucleic acid that encodes a protein or peptide as a string of codons in a specific reading frame. Within this specific reading frame, an ORF can contain any codon specifying an amino acid, but does not contain a stop codon. The ORFs in the starting collection need not start or end with any particular amino acid. In different aspects of the disclosure, an ORF is either continuous or is interrupted by one or more introns.

Operably linked: The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

Peptide bond: A "peptide bond" is a covalent bond between a first amino acid and a second amino acid in which the alpha-amino group of the first amino acid is bonded to the alpha-carboxyl group of the second amino acid.

Percentage of sequence identity: The term "percent sequence identity" refers to the degree of identity between any given query sequence, e.g. SEQ ID NO: 102, and a subject sequence. A subject sequence typically has a length that is from about 80 percent to 200 percent of the length of the query sequence, e.g., 80, 82, 85, 87, 89, 90, 93, 95, 97, 99, 100, 105, 110, 115, or 120, 130, 140, 150, 160, 170, 180, 190 or 200 percent of the length of the query sequence. A percent identity for any subject nucleic acid or polypeptide relative to a query nucleic acid or polypeptide is determined as follows. A query sequence (e.g. a nucleic acid or amino acid sequence) is aligned to one or more subject nucleic acid or amino acid sequences using the computer program ClustalW (version 1.83, default parameters), which allows alignments of nucleic acid or protein sequences to be carried out across their entire length (global alignment, Chenna 2003).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher website and at the European Bioinformatics Institute website on the World Wide Web (ebi.ac.uk/clustalw).

To determine a percent identity of a subject or nucleic acid or amino acid sequence to a query sequence, the sequences are aligned using Clustal W, the number of identical matches in the alignment is divided by the query length, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Plasmid: The terms "plasmid" and "vector" refer to genetic elements used for carrying genes which are not a natural part of a cell or an organism. Vectors can either integrate into the genome or can be maintained extrachromosomally as linear or circular DNA fragments. Such elements include but are not limited to autonomously replicating sequences; genome integrating sequences; origins of replication; bacteriophage or nucleotide sequences, linear or circular, of a single- or double-stranded DNA or RNA, derived from any source, in which a number of nucleotide sequences have been joined or recombined into a unique construction which is useful for introducing polynucleotide sequences into a cell or an organism.

Polypeptide or protein: The terms "polypeptide" or "protein" denote a polymer composed of a plurality of amino acid monomers joined by peptide bonds. The polymer comprises 10 or more monomers, including 10, 11, 12, 13, 14, 15, 16, 17, 18, 19, 20, 30, 40, 50, 60, 70, 80, 90, 100, 200, 300, 400, 500, 600, 700, 800, 900, 1000, 2000, 3000, 4000, 5000 or any length in between. A preferred polypeptide or protein of the disclosure is a single-subunit RNA polymerase.

Promoter: The term "promoter" refers to a DNA sequence capable of controlling the expression of a coding sequence or functional RNA. In general, a coding sequence is located 3' to a promoter sequence. In different aspects, promoters are derived in their entirety from a native gene, or are composed of different elements derived from different promoters found in nature, or even comprise synthetic DNA segments. It is understood by those skilled in the art that different promoters direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

Single-subunit RNA polymerase: A "single-subunit RNA polymerase", as used herein, is an enzyme with DNA-dependent RNA polymerase activity capable of synthesizing RNA from a DNA template in vitro in a pure form, without the presence or addition of any other proteins or peptides into the reaction.

Transformed: The term "transformed" means genetic modification by introduction of a polynucleotide sequence.

Transformation: As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

Transformed Organism: A transformed organism is an organism that has been genetically altered by introduction of a polynucleotide sequence into the organism's genome.

The term unfavorable conditions as used herein implies any part of the growth condition, physical or chemical, that results in slower growth than under normal growth conditions, or that reduces the viability of cells compared to normal growth conditions.

We describe novel single-subunit RNA polymerases that are suitable for RNA manufacturing in vitro. These enzymes are related, by sequence and/or structure, to the T7 RNA polymerase that is widely used for RNA synthesis in vitro, in particular in the manufacture of RNA for use in pharmaceuticals, diagnostics, vaccines, medicaments, therapeutics, and cosmetics. However, by virtue of their varying level of sequence similarity to T7 RNA polymerase, these enzymes have very different properties.

For example, the ability of a single-subunit RNA polymerase to synthesize a uniform population of RNA molecules in vitro decreases with the length of the DNA molecule used as a template for the RNA polymerase. Certain RNA polymerases have higher processivity than others and are capable of synthesizing highly uniform RNAs >1 kb in length or longer.

Single-subunit RNA polymerases also differ in their ability to utilize non-natural nucleotides and incorporate these into the RNA molecule. Examples of such non-natural nucleotides are 2'-0-methyl NTPs, 2'-fluoro NTPs, pseudouridine-5'-triphosphate and N1-methylpseudouridine-5'-Triphosphate. The 2' hydroxyl of ribonucleotides has frequently been targeted for modification because this group is primarily responsible for the low stability of RNA under basic conditions. Various modifications at the 2' position of nucleotides have been tested for increasing RNA stability. However, single-subunit RNA polymerases tend to incorporate such modified nucleotides inefficiently. Alternatively, RNA molecules containing such modified nucleotides may exhibit a high rate of sequence errors. Specific single-subunit RNA polymerases among the ones listed in SEQ ID NO: 1 through SEQ ID NO: 41 of this disclosure are able to incorporate modified nucleotides efficiently without compromising sequence fidelity.

Single-subunit RNA polymerases differ in their RNA yield based on the nucleotides added to an in vitro transcription reaction. For example, a 20 μl in vitro transcription reaction containing 1 mM of each of the four nucleotide triphosphates ATP, CTP, GTP and TTP can yield up to about 25 μg of RNA assuming equal representation of each of the nucleotides in the DNA template. An RNA polymerase that synthesizes 10 μg of RNA in such a reaction has a yield of 40%. Higher-yielding RNA polymerases are of value as they maximize the amount of RNA product made from a specific amount of nucleotide triphosphates added to the reaction. For example, the single-subunit RNA polymerases disclosed herein produce a transcript yield that is greater than that generated by T7 RNA polymerase, and in some cases at temperatures less than 24° C. is a much as a two-fold, three-fold, or four-fold increase. Similarly, when using modified nucleotides the transcript yield of the single-subunit RNA polymerases disclosed herein can be as a two-fold or three-fold increase, depending upon the modified nucleotide used as compared to T7 RNA polymerase.

Single-subunit RNA polymerases differ in the amount of double-stranded RNA made in a reaction. Double-stranded RNA is a frequent and undesirable side product of in vitro transcription reactions (Mu 2018, Gholamalipour 2018), and its reduction or elimination reduces the cost of synthesizing pharmaceutical-grade RNA.

Single-subunit RNA polymerases differ in their temperature specificity or reaction speed at varying temperatures, both of which are important parameters in RNA synthesis. Lower reaction temperatures such as between 10 and 20° C. can stabilize the RNA. However, T7 RNA polymerase has very low activity at such temperatures. It is therefore of value to identify RNA polymerases active at low temperatures.

Single-subunit RNA polymerases differ in their overall reaction speed, irrespective of temperatures. Faster enzymes are typically more desirable because shorter reaction times reduces RNA degradation.

Single-subunit RNA polymerases differ in their sequence fidelity. High-fidelity enzymes will produce RNAs that faithfully encode a protein of interest, and therefore have a higher activity in therapeutic applications.

A novel single-subunit RNA polymerase is identified in sequence databases using iterative sequence searches by virtue of its sequence identity with T7 RNA polymerase, T3 RNA polymerase, SP6 RNA polymerase or other well-characterized single-subunit RNA polymerases (Butler 1982, McGraw 1985, Studier 1986). For example, BLAST searches are performed using the protein sequences of T7 RNA polymerase, T3 RNA polymerase or SP6 RNA polymerase as query sequences, collecting the resulting protein sequences and performing additional rounds of BLAST searching.

The resulting protein sequences are then grouped into a phylogenetic tree, for example using Clustal Omega, the Armadillo Workflow Platform, Treefinder, Phybase programs and the like. Representative enzymes are selected from various parts of the tree for expression and testing.

To facilitate protein purification, a coding sequence encoding an enzyme of interest is modified with a short sequence encoding an epitope tag or purification tag. Such tags are routinely used in protein biochemistry and are typically added to either the 5' end or 3' end of a sequence encoding an enzyme or a protein, such that the peptide encoded by the tag will be found either at the N-terminus or at the C-terminus of the encoded protein. Examples of frequently used epitope tags are a polyhistidine tag (or His-tag), a FLAG tag.

A His-tag comprises a string of histidine residues from four to ten residues in succession, typically consisting of six histidine residues (His6 tag). Some proteins are engineered with two His6 tags, or with a polyhistidine stretch longer than 6 histidine residues.

A FLAG tag consists of the peptide sequence DYKDDDDK (SEQ ID NO:165), which like the His tag is added to a proteins N- or C-terminus.

Numerous other tags are known to those trained in the art and include the following: AviTag, encoded by the peptide sequence GLNDIFEAQKIEWHE (SEQ ID NO:166), a peptide allowing biotinylation by the enzyme BirA allowing the protein to be isolated by streptavidin; Calmodulin-tag, encoded by the peptide sequence KRRWKKNFIA-VSAANRFKKISSSGAL (SEQ ID NO: 167), a peptide bound by the protein calmodulin; Polyglutamate tag, encoded by the peptide sequence EEEEEE (SEQ ID NO:183), a peptide binding efficiently to anion-exchange resin such as Mono-Q; E-tag, encoded by the peptide sequence GAPVPYPDPLEPR (SEQ ID NO:168), a peptide recognized by an antibody; HA-tag, encoded by the peptide sequence YPYDVPDYA (SEQ ID NO:169), a peptide from hemagglutinin recognized by an antibody; Myc-tag, encoded by the peptide sequence EQKLISEEDL (SEQ ID NO:170), a peptide derived from c-myc recognized by an antibody; NE-tag, encoded by the peptide sequence TKEN-PRSNQEESYDDNES (SEQ ID NO:171), a synthetic peptide recognized by a monoclonal IgG1 antibody; S-tag, encoded by the peptide sequence KETAAAKFERQHMDS (SEQ ID NO:172), a peptide derived from Ribonuclease A; SBP-tag, encoded by the peptide sequence MDEKTTGWRGGHVVEGLAGELEQLRAR-LEHHPQGQREP (SEQ ID NO:173), a peptide which binds to streptavidin; Spot-tag, encoded by the peptide sequence PDRVRAVSHWSS (SEQ ID NO:174), a peptide recognized by a nanobody; Strep-tag, encoded by the peptide sequence WSHPQFEK (SEQ ID NO:175), a peptide which binds to streptavidin or the modified streptavidin streptactin; Ty tag, encoded by the peptide sequence EVHTNQDPLD (SEQ ID NO:176); V5 tag, encoded by the peptide sequence GKPIPNPLLGLDST (SEQ ID NO:177), a peptide recognized by an antibody; VSV-tag, encoded by the peptide sequence YTDIEMNRLGK (SEQ ID NO:178), a peptide recognized by an antibody; Xpress tag, encoded by the peptide sequence DLYDDDDK (SEQ ID NO: 179).

A polynucleotide sequence encoding the peptide sequence of an epitope or purification tag can be joined directly to the coding sequence of an enzyme of interest, or can be joined to this coding sequence via an intervening linker sequence encoding additional amino acid residues. The use of a linker sequence separates the epitope or purification tag from the enzyme or protein of interest, making the tag more accessible to affinity reagents such as antibodies or affinity resins. A simple linker, GGTAGC, encodes the dipeptide Gly-Ser and creates separation between an epitope tag and a protein or enzyme of interest.

Linker sequences that separate two or more ORFs in a fusion polynucleotide can range between 3 and 99,999 nucleotides in length. For example linker sequences can be 3, 6, 9, 12, 15, 18, 21, 24, 27, 30, 60, 90, 120, 150, 180, 210, 240, 270, 300, 600, 900, 1200, 1500, 1800, 2100, 2400, 2700, 3000, 6000, 9000, 12000, 15000, 18000, 21000, 24000, 27000, 30000, 60000, 90000, or 99999 base pairs in length, or any length in between. A polynucleotide linker sequence typically has a nucleotide length divisible by 3 to encode an integral number of amino acid-coding codons.

In one aspect of the disclosure, a linker sequences also contains one or more introns which are spliced out of mRNAs in eukaryotic organisms.

In another aspect of the disclosure, a nucleic acid sequence encoding an epitope tag or purification tag are fused to an open reading frame encoding an enzyme of interest without any linker sequence, by directly joining the last codon of the enzyme coding sequence to the first codon of the epitope tag or purification tag, or alternatively by joining the last codon of the epitope tag or purification tag to the first codon of the enzyme coding sequence.

Linker sequences encode linker peptide or polypeptide sequences that are suitable for separating the two parts of a fusion protein. Small amino acids, such as glycine, alanine, serine, proline, threonine, aspartic acid or asparagine are suitable for linker peptides because they tend to form flexible and unstructured domains, or alpha-helical domains lacking bulky side groups, that allow separation between the two parts of the encoded randomized fusion polypeptide and that allow each part of the encoded randomized fusion polypeptide to move independently relative to the other. Accordingly, sequence insertions separating the two fused ORFs contains codons specifying these amino acids. Alternatively, the linker peptide sequence are designed to contain a specific secondary structure, such as an alpha helix, beta sheet, coiled coil or turn, or combinations thereof, permitting the two parts of the fusion polypeptide to be separated by a specific structure or combinations of specific structures.

The linker sequence separating the two ORFs in a fusion polynucleotide often encodes a short peptide that is rich in glycine and serine residues. Such a peptide is expected to be unstructured and will provide a flexible protein spacer separating the two members of a fusion polypeptide while being relatively resistant to proteolysis. Examples of suitable linker peptide sequences are GGGGSGGSGGSGGGGS (SEQ ID NO:180) or SGGS-SAAGSGSG (SEQ ID NO:181) or SAGSSAAGSGSG (SEQ ID NO:182) (Wang 2010). In another aspect of the disclosure, alpha-helical linker sequences are used, for example the sequence A(EAAAAK)nA, n=2-5 (Arai 2001; SEQ ID NO:184-187). It is possible to optimize linker sequences for a specific fusion polynucleotide or fusion polypeptide by varying the length and sequence of the linker sequence and selecting for the variant that encodes the most active, stable or effective fusion polypeptide (Arai 2001, Wang 2010).

Any open reading frame or coding sequence can be used as a linker sequence; Linker sequences include natural sequences encoded in the genome of a specific organism, or artificial sequences derived by de novo design or randomized synthesis, or natural sequences that are optimized by codon optimization, adjustment of GC content, or other methods for varying polynucleotide or polypeptide sequences.

Typically, linker sequences are designed to encode polypeptides that are resistant to proteolysis, or whose sequence is not cleaved by proteases present in the host cell. However, in another aspect of the disclosure, a linker sequence is specifically designed to be cleaved by cellular proteases by designing the linker sequence in a manner that it encodes a protease recognition site.

Different methods are used to generate a nucleic acid sequence encoding specific enzymes selected for testing. For example, the native enzyme coding sequence is identified in sequence databases by virtue of its association in the database with the protein sequence, or via the complete genome sequence of a bacteriophage encoding the enzyme of interest. Alternatively, the protein sequence is reverse translated into a nucleic acid sequence taking the codon preferences of the host organism into account that is to be used for protein expression.

Synthetic nucleic acid sequences encoding an enzyme of interest are created using methods known to those trained in the art. For example, a synthetic nucleic acid sequence that encodes a specific peptide sequence is generated manually using the genetic code in combination with a table of codon usage of the appropriate host organism. Alternatively, this is done using a reverse translation program such as the ones available at the internet sites bioinformatics.org, geneinfinity.org or the internet site operated by the European Bioinformatics Institute, part of the European Molecular Biology Laboratory. Reverse translation programs are also available through commercial suppliers of gene synthesis which makes such programs available as part of the process of ordering synthetic genes.

Recombinant protein expression in *E. coli* and other bacteria is generally carried out in the same general sequence of steps as outlined below. The gene encoding the product of interest in inserted into a plasmid DNA molecule. The insertion is accomplished by a number of cloning methods known to those skilled in the art including, but not limited to, traditional cloning using restriction enzymes and DNA ligase (ligation-dependent cloning), agarose gel-free cloning, ligation-independent (or ligation-free) cloning, site-specific recombination, homology-dependent cloning, recombinational cloning, homology-dependent end joining, annealing of single-stranded ends, linker tailing, topoisomerase-catalyzed cloning, enzyme-free cloning, and others.

"Joining nucleic acid molecules" as used herein refers to any method that results in the molecules being operably linked at room temperature. Such methods include, but are not limited to, covalent linkage (ligation), annealing of complementary strands of nucleic acid molecules and other ways of associating two or more nucleic acid molecules.

In one specific aspect of the disclosure, homologous sequences at the ends of the 5' and 3' polynucleotides to be joined are used to direct or mediate the joining event. A large number of methods accomplish such homology-dependent assembly (Lobban 1973), including linked tailing (Lathe 1984), In-Fusion cloning (Zhu 2007, Irwin 2012), Sequence and Ligation-Independent Cloning (SLIC, Li 2007, Li 2012), FastCloning (Li 2011), Circular Polymerase Extension Cloning (Quan 2009, Quan 2011), the Gibson assembly method (Gibson 2009, Gibson 2010), Quick and Clean Cloning (Thieme 2011), and others (Vroom 2008).

Typically, individual clones of enzyme coding sequences, inserted into a cloning vector or expression vector of choice, are sequence verified before their use in protein expression. Sequence verification uses the Sanger sequencing process applied to purified plasmid DNA in combination with oligonucleotide primers recognizing specific sequences in the enzyme coding sequence or the cloning vector/expression vector.

Plasmid molecules suitable for encoding the polynucleotides encoding enzymes described in the present disclosure include high-copy, low-copy or single-copy plasmids. In *E. coli*, an example of a high-copy plasmid is one carrying the pMB1 origin of replication such as the pUC plasmids and their derivatives (Yanish-Perron 1985); medium-copy plasmids include those based on the p15A/pACYC, RK2 (Meyer 1975, Schmidhauser 1983, Schmidhauser 1985) or RSF1010 plasmid backbones (Chang 1978, Bagdasarian 1981, Tsygankov 1985, Rose 1988); low-copy plasmids include mini-F' plasmids such as those based on pBeloBAC11 (Shizuya 1992). Some of these plasmids are very species-specific while others are capable or replication in multiple bacterial species. For example, plasmids RK2 and RSF1010 are capable of replication in all species of gram negative bacteria.

When expressing two different proteins in the same bacterial strain, it is possible to encode the two proteins on different plasmids or alternatively on the same plasmid. When using different plasmids, the two plasmids contain different replicons that are compatible with one another, meaning that both are maintained in the same cell. Such simultaneous maintenance of two plasmid types in a single bacterial cell is often facilitated by the presence of different antibiotic-resistance markers on the two plasmids.

For stable integration of fusion polynucleotides on the bacterial chromosome, a number of genome engineering methods are used to randomly or precisely place a fusion polynucleotide, linked to a promoter and terminator, into chromosomal locations (Schweizer 2008, Madyagol 2011, Leprince 2012, Richter 2012, Jeong 2013). Common methods of inserting genes into the bacterial chromosome include spontaneous random integration upon transformation, P1 phage transduction, bacteriophage lambda integration, site-specific integration, or other methods.

Promoters used for expression of fusion polynucleotides may be strong promoters that result in high levels of protein expression, or weak promoters that result in low levels of protein expression, or promoters of intermediate strength. Promoters may also be constitutive, being expressed in all or most cells and in all or most stages of growth, or specific promoters whose activity depends on specific growth states or metabolic states. Inducible promoters, whose activity depends on the presence of a specific chemical or metabolite or growth condition which induces the promoter to be active, or repressible promoters, which are shut off or reduced in activity in the presence of a specific chemical or metabolite or growth condition are also suitable. For example, a synthetic gene encoding am RNA polymerase of interest is expressed using a promoter that is inducible by arabinose in the culture medium, with low or no promoter activity in the absence of arabinose. Such arabinose-inducible promoters are frequently used for expression of proteins in *E. coli*. Another aspect of the disclosure uses a promoter identical to or a derivative of the bacterial lac promoter that is inducible with the synthetic lactose analog isopropyl β-D-1-thiogalactopyranoside (IPTG). In another aspect of the disclosure, promoters are used that are induced under conditions of abiotic stress or in the presence of toxic and growth-inhibiting compounds in the growth medium. The strength of the promoter can be varied to create the optimal environment for expression of soluble, active recombinant protein—this can be determined empirically for each recombinant protein.

Terminators used for expression of fusion polynucleotides also vary in their activity. The function of a terminator in gene expression is in completing the transcription process and influencing mRNA half-life. Expression cassettes of fusion polynucleotides contain either strong or weak terminators or terminators of intermediate activity that predispose an mRNA to high, low or intermediate levels of stability. Such terminators are suitable for pairing with strong, weak or intermediate promoters to achieve a desirable level of gene expression.

In order to accomplish high-level expression, many gene signals must be optimized. Typically, the gene is inserted immediately downstream of a strong *E. coli* promoter that will result in large quantity of transcript. This promoter can be constitutive or inducible. Examples of inducible promoters are the T7 bacteriophage promoter and the arabinose promoter although many more examples are found in the literature. Inducible promoters allows for the controlled expression of the product of interest. When using the T7 bacteriophage promoter, *E. coli* strains are often used that contain an integrated copy of the T7 RNA polymerase under control of the bacterial lac promoter (inducible by IPTG). An example of such a strain is the *E. coli* protein expression strain BL21(DE3).

In addition to a promoter, the target gene must contain a sequence of nucleotides called a ribosome binding site (or Shine Delgarno sequence in bacteria) immediately upstream of the start of the coding region. Numerous ribosome binding sites have been identified in the literature, and these tend to be purine-rich. High level expression is also potentiated by insertion of a transcription termination site immediately downstream of the coding region of the target gene. Many transcription termination sites have been reported in the literature and are used for this purpose.

Nucleic acid sequences encoding an enzyme of interest are used to express protein in one of two general ways: in vitro using a cell-free system and in vivo using a host organism. In both cases, a nucleic acid template molecule generated by cloning or PCR amplification from a synthetic gene is used to direct expression of the RNA polymerase of interest.

Cell-free expression systems have multiple advantages over use of live expression hosts, including fast reaction times, high reproducibility, high yield in small reactions, relatively high starting purity of the protein of interest, and independence of toxic effects of the expressed protein. The relatively low complexity of proteins present in these reactions allows rapid and accurate assessment of translation efficiency of each candidate enzyme. However, cell-free expression systems are expensive and do not scale as easily as in vivo expression systems.

Expressing a protein or an enzyme using a cell-free expression system uses the following procedure, or a variant thereof. Each sequence-verified enzyme coding sequence is joined at its 5' end to a sequence encoding a suitable promoter (for example the T7 promoter), a 5' untranslated sequence (5' UTR) (for example the T7 5' UTR), including a translation initiation sequence, and at its 3' end to a sequence encoding a 3' untranslated sequence (3' UTR) and a suitable terminator. The sequences are joined using any cloning or sequence assembly methods known to those trained in the art, including the methods listed above. A promoter, 5' UTR and translation initiation site can also be incorporated into a nucleic acid sequence encoding an enzyme by PCR amplification, by incorporating the promoter, 5' UTR and translation initiation site into the 5' PCR primer. A 3' UTR and terminator can also be incorporated into a nucleic acid sequence encoding an enzyme by PCR amplification, by incorporating the 3' UTR and terminator into the 3' PCR primer.

The nucleic acid molecule suitable for cell-free protein expression that results from the sequence assembly described in the preceding paragraph will result in a nucleic acid molecule comprising a promoter, 5' UTR, translation initiation site, enzyme ORF, 3' UTR and terminator.

The nucleic acid molecule suitable for cell-free protein expression is then combined with a commercially available cell-free expression system, or a custom-made cell free expression system, to express the enzyme of interest. Commercially available expression systems include coupled in vitro transcription/translation systems that use prokaryotic cell extracts derived from *E. coli* and/or *E. coli* infected with bacteriophages. Others use cell extracts derived from rabbit reticulocytes or wheat germ.

For protein expression using a live expression host, the following general procedure is followed. Once the enzyme coding sequence has been inserted into an expression vector and the sequence has been verified, the resulting nucleic acid construct must be introduced into a protein expression host of interest. The expression host can be any organism capable of protein synthesis, including *E. coli, Saccharomyces cerevisiae, Schizosaccharomyces pombe, Bacillus subtilis, Pseudomonas fluorescens*, other *Pseudomonas* species, other species of bacteria, other species of yeast, filamentous fungi for example those in the genera *Aspergillus* or *Trichoderma*, cultured insect cells or cultured mammalian cells.

The expression vector construct is introduced into a suitable expression host by chemical transformation methods (i.e. transformation facilitated by calcium chloride or other cations, polyethylene glycol, dimethyl sulfoxide), or by physical transformation methods (i.e. electroporation), or by combinations thereof.

There is a wide choice of bacterial strains for expression. Important features of the host strain include compatibility with the promoter system (i.e. T7 RNA polymerase needs to be present in the host strain when using the T7 promoter driving expression of the target protein), presence (or absence) of potentially protein-destroying proteases, presence or absence of additional elements to facilitate expression of the target such as chaperones, is considered. In many instances, the overexpression of a recombinant protein yields a product that during protein synthesis folds in an aberrant fashion such that its product is insoluble and precipitates out in a structure called an inclusion body. Protein produced in this manner are, by definition, inactive and do not retain their normal enzymatic or structural activities.

Overexpression of the target protein of interest is then accomplished by growing the bacteria in optimal media (rich media such as Luria-Bertani medium or minimal media such as M9 medium) at a temperature optimal for the expression of the target protein (37° C., 30° C., room temperature, 20-25° C., 18° C. and 15° C. are all commonly used). The medium may contain an inducer molecule (for example arabinose or IPTG) that activates an inducible promoter. The inducer molecule is added at a specific time during cultivation, for example when the culture has reached a specific optical density, in order to induce the target protein of interest at that time.

The cells are then cultured on a shaker for an appropriate amount of time to ensure optimal expression of recombinant protein. The culturing time can be anywhere between 30 minutes and 144 hours, including 30 minutes, 1 hour, 2 hours, 3 hours, 4 hours, 5 hours, 6 hours, 10 hours, 12 hours, 24 hours, 36 hours, 48 hours, 60 hours, 72 hours, 96 hours, 120 hours and 144 hours or any time in between). The culturing time after adding an inducer molecule can vary anywhere between 10 minutes and 144 hours, including 30 minutes, 1 hour, 2 hours, 3 hours, 4 hours, 5 hours, 6 hours, 10 hours, 12 hours, 24 hours, 36 hours, 48 hours, 60 hours, 72 hours, 96 hours, 120 hours and 144 hours or any time in between).

Cells are harvested by centrifugation, resuspended in a suitable lysis buffer, the cells are lysed and target protein recovered and purified by any of numerous methods to isolate recombinant protein.

Cell lysis methods include physical methods (sonication, French press, mortar and pestle grinding, dounce homogenizer, disruption in a waring blender, lysis by freeze-thaw, shaking with glass beads), enzymatic methods (i.e. cell treatment with lysozyme), chemical methods (i.e. cell treatment with acids, bases, detergents or combinations thereof), or combinations thereof.

For protein purification, if target protein is in native form (i.e. does not contain purification facilitation tags), target protein are separated from the *E. coli* host proteins by a number of chromatography steps optimized for the protein of interest. When the target protein contains a purification tag, columns or magnetic beads containing material to specifically bind the tag is used to separate the target from the host proteins. In either instance the target protein is then specifically eluted to obtain more highly purified product.

Often, recombinant protein is folded incorrectly during its synthesis. Reasons for incorrect folding include speed of expression in *E. coli* (compared with the organism the protein is encoded by), lack of folding assisting chaperones or similar foldases, or specific interactions with host proteins not encountered in the native organism. Incorrect folding often leads to recombinant protein becoming insoluble in the host cytoplasm and precipitating out from the host cell lysate during purification. Such protein precipitates often form visual particles within the cell that are referred to as inclusion bodies. Protein produced in insoluble or precipitated form that does not fold correctly will not retain its normal enzymatic or structural activity.

Purification of proteins incorporating His-tags relies on immobilized metal affinity chromatography, in which transition metal ions are immobilized on a resin matrix using a chelating agent such as iminodiacetic acid. Ni2+ is the most frequently used ion for purification of a his-tagged recombinant protein is, although Co2+, Cu2+, and Zn2+ are also used. The His-tag has a high affinity for these metal ions and binds strongly to chelating resin. Most other cellular proteins will not bind to the resin, or will bind only weakly. The combination of a His-tag and immobilized metal affinity chromatography enables rapid generation of pure protein from a crude lysate.

Imidazole competes with the his-tag for binding to the metal-charged resin and thus is used for elution of the protein from an IMAC column Typically, a low concentration of imidazole is added to both binding and wash buffers to interfere with the weak binding of other proteins and to elute any proteins that weakly bind. His-tagged protein is then eluted with a higher concentration of imidazole.

Ni2+ is most commonly used for his-tag purification since it gives a high yield. Using Co2+ can give higher purity but with a lower yield. Bio-Rad has his-tag resins and his-tag purification kits that are precharged with Ni2+ for fast, easy his-tag protein purification. Uncharged resins and kits that can be charged with Co2+ or other divalent or trivalent metal ions are also available. Uncharged kits give users the option of trying different metals to determine if one gives higher purity or yield for a particular his-tagged recombinant protein.

After a protein has been purified, its purity and concentration is assessed using a number of methods, including SDS-polyacrylamide gels.

A purified RNA polymerase is tested in in vitro transcription reactions in order to optimize its activity and assess its ability to produce RNA under a variety of conditions. In vitro transcription reactions typically contain buffers and salts, a divalent cation such as Mg+2, a nucleic acid template molecule, at least four nucleotide triphosphates (ATP, CTP, GTP and UTP), and the RNA polymerase enzyme. In vitro transcription reactions are typically run between 20° C. and 42° C. for 30 minutes to 6 hours.

The nucleic acid template molecule present in an in vitro transcription reaction serves as a template for synthesis of the RNA by an RNA polymerase. In one aspect-of the disclosure, the nucleic acid template molecule is a double-stranded DNA molecule. The nucleic acid template molecule typically contains a promoter sequence recognized by a particular single-subunit RNA polymerase, and additional sequence downstream of the promoter. The sequence downstream of the promoter can encode a structural RNA or a protein. The sequence downstream of the promoter can vary in length between 50 base pairs and 100 kilobases, for example 50, 60, 70, 80, 90, 100, 150, 200, 300, 400, 500, 600, 700, 800, 900, 1000, 2000, 3000, 4000, 5000, 6000, 7000, 8000, 9000, 10000, 20000, 30000, 40000, 50000, 60000, 70000, 80000, 90000, 100000 base pairs or any length in between.

The promoter sequence contained in the nucleic acid template molecule present in an in vitro transcription reaction is often specific to a particular single-subunit RNA polymerase and needs to be predicted or discovered to allow the RN polymerase to be tested in in vitro transcription reactions. The promoter sequence recognized by a specific single-subunit RNA polymerase is discovered through one or more of several bioinformatic or molecular genetic methods. The bioinformatics methods include alignments of sequences found upstream of open reading frames in bacteriophage genomes encoding single-subunit RNA polymerases and sequence motif searches within sequences found upstream of open reading frames in bacteriophage genomes encoding single-subunit RNA polymerases. An example of a molecular genetic method is the generation of sequence data from reverse transcribed RNAs derived from in vitro transcription reactions containing a specific RNA polymerase and genomic DNA from the bacteriophage that encodes the polymerase, or from a closely related bacteriophage, followed by alignment of the resulting sequence data to the bacteriophage genome sequence and deduction of the location of the promoter and its sequence. Other examples of molecular genetic methods are DNAse I protection assays, run-off in vitro transcription assays using fragments of a bacteriophage genome, and related methods.

The promoter sequence recognized by a particular single-subunit RNA polymerase is followed by one or more nucleotides that constitute the transcriptional start site of the polymerase (Imburgio 2000). The transcriptional start site often contains a purine residue that directs the placement of the first nucleotide in the RNA molecule. The transcriptional start site placed downstream of the promoter sequence may be critical for efficient RNA synthesis by the RNA polymerase (Imburgio 2000). Depending on the preferences of the particular single-subunit RNA polymerase, the transcriptional start site may have any dinucleotide or trinucleotide sequence, such as GG, GA, GC, GT, AA, AC, AG, AT, CA, CC, CG, CT, TA, TC, TG, TT, GGG, GGA, GGC, GGT, GAA, GAC, GAG, GAT, etc. The transcriptional start site may be positioned immediately downstream of the promoter sequence, or separated from the promoter sequence by one or more nucleotides, such as 1, 2, 3, 4, 5, 6, 7, 8, 9, 10, 11, 12, 13, 14, 15, 16, 17, 18, 19 or 20 nucleotides.

The reaction conditions of an in vitro transcription reaction is varied in order to determine specific properties of a single-subunit RNA polymerase or optimize the activity of such enzyme. For example, the reaction pH can vary from acidic (pH 4.0-6.5), neutral (pH 6.5-8.0) or basic (pH 8.0-10.0), or any values within these ranges or in between.

The in vitro transcription reaction contains one or more divalent cations required for RNA polymerase activity, such as Ca+2, Mg+2, Mn+2, Co+2, Zn+2 or others, or any combinations thereof. The concentration of the divalent cation can vary, for example from 1 nM to 100 mM or any concentration in between. The divalent cations added to the reaction can be in the form of various salts thereof, such as Cl-salts, acetate salts or other salts used in molecular biology.

The in vitro transcription reaction contains buffering agents such as Tris, HEPES, PIPES, acetate or other buffering agents used in molecular biology. Other salts can be present in the reaction mixture, such as NaCl, KCl, LiCl, sodium acetate, potassium acetate, lithium acetate or any other salts commonly used in molecular biology or any combinations thereof. These salts are present in the reaction in any concentration ranging from 0 mM to 2 M.

The in vitro transcription reaction contains various nucleotide triphosphates, minimally the set of four natural ribonucleotide triphosphates ATP, CTP, GTP and UTP. Non-natural or modified nucleotide triphosphates may also be present, such as 2'-0Me NTPs, 2'-F NTPs, pseudo-UTP, 5-methyl-CTP or any of a number of other modified nucleotides (Padilla 2002, Kariko 2008, Siegmund 2012, Sahin 2014, Andries 2015, Meyer 2015, Sergeeva 2016, Pardi 2017, Potapov 2018). Nucleotides are present in the reaction at concentrations ranging from 1 nM to 50 mM.

The in vitro transcription reaction can also contain polyamines such as spermidine and spermine or diamines such as putrescine and cadaverine, present in concentrations ranging from 0 to 10 mg/ml.

The in vitro transcription reaction can also contain 5'-capping compounds or dinucleotide caps designed to stabilize the 5' end of the RNA against degradation, or to give it specific properties such as a high efficiency of translation in a specific organism. Capping compounds often have a dinucleotide structure such as 7-methyl-guanosine triphosphate-guanosine (m7GpppG) but can have other sequences and structures, including various modification of the ribose moieties or bases in the dinucleotide cap (Konarska 1984, Darzynkiewicz 1988, Pasquinelli 1995, Stepinski 2001). A capping compound can contain any sequence of two nucleotides, such as G-G, G-A, G-C, G-I, G-T, G-U, A-A, A-C, A-G, A-I, A-T, A-U, C-A, C-C, C-G, C-I, C-T, C-U, T-A, T-C, T-G, T-I, T-T, T-U, U-A, U-C, U-G, U-I, U-T, U-U, or any other dinucleotide sequence. The two nucleotides in the capping compound can be linked by any linkage or bond, such as the triphosphate linkage found in m7GpppG, monophosphate linkages, diphosphate linkages, phosphorothioate linkages, or any other chemical group or covalent bond linking the two nucleotides. Each nucleotide in the cap may be modified by methylation such as the 7-methyl-guanosine residue fond in m7GpppG, or by any other modification of the nucleotide, whether present on the ribose moiety or the base moiety (Pasquinelli 1995, Stepinski 2001). Capping compounds may contain more than two nucleotides, such as 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 200, 300, 400, 500, 600, 700, 800, 900 or 1000 nucleotides in length, or any length in between, containing any sequence of nucleotides linked in any manner and containing any nucleotide modifications. Capping compounds can be present in the reaction at concentrations ranging from 0 to 100 mM.

The in vitro transcription reaction can also contain other proteins such as bovine serum albumin, gelatin, milk proteins, and/or hydrolysates thereof, as stabilizers of the RNA polymerase or modifiers of RNA polymerase activity. These proteins are present in concentrations ranging from 0 μg/ml to 20 mg/ml.

The in vitro transcription reaction can also contain soluble polysaccharides such as starch, modified starch, glycogen, pectin, xanthan gum, dextran, welan gum, gellan gum, diutan gum, alginate, agar, agarose and pullulan. These polymers may be present in concentrations ranging from 0 μg/ml to 20 mg/ml.

The in vitro transcription reaction can also contain other polymers used in molecular biology as crowding agents and enzyme stabilizers, such as polyethylene glycol (PEG), polyvinyl pyrrolidone (PVP), dextran sulfate and others used in molecular biology, present in concentrations ranging from 0 μg/ml to 20 mg/ml.

The in vitro transcription reaction can also contain sugars as osmotic agents or stabilizers such as sorbitol, mannitol, sucrose, trehalose, or any other mono- or disaccharide, present in concentrations of 0 to 1 M.

The in vitro transcription reaction can also contain molecules such as glycerol, betaine (trimethylglycine), dimethylsulfoxide or trehalose that are used in molecular biology as antifreeze compounds, enzyme stabilizers and modulators of enzyme activity, present at concentrations of 0 to 2 M.

The in vitro transcription reaction can also contain destabilizers of base pairing such as formamide or urea.

The in vitro transcription reaction can also contain wetting agents or detergents such as Nonidet P40, Tween20, Triton X-100 or any other detergent used in molecular biology, present at concentrations of 0 to 10 mg/ml.

The in vitro transcription reaction is incubated at various temperatures ranging from 10° C. to 80° C., 18° C. to 50° C., 10° C. to 50° C., 10° C. to 20° C. or any temperature in between, such as 18° C., 24° C., or 37° C., to name but a few.

The in vitro transcription reaction is run for an amount of time as low as 5 minutes ranging to 48 hours, or any time in between.

The RNA generated in an in vitro transcription reaction is characterized for its length, sequence, amount of double-stranded RNA and ability to serve as template for synthesis of active protein using a variety of methods developed for RNA analysis. Agarose gel electrophoresis methods are used to estimate the RNA amount and characterize its size distribution. Commercially available systems for nucleic acid analysis such as the Agilent Bioanalyzer are also used to determine RNA size and estimate RNA amounts. The uniformity of the size distribution of an RNA sample is estimated in the same manner, using either agarose gel electrophoresis or a Bioanalyzer, or related methods.

RNA sequence is determined by reverse transcribing RNAs synthesized by a particular RNA polymerase and sequencing the resulting DNA molecules by any of a variety of sequencing methods, including Sanger sequencing, pyrosequenceing, nanopore sequencing, sequencing by ligation, sequencing by synthesis, and any other next-generation, $2^{nd}$-generation or $3^{rd}$-generation sequencing systems such as those produced by Illumina Corporation, Ion Torrent Inc, Oxford Nanopore or equivalent.

The amount of double-stranded RNA is determined using RNA blots or dot blots employing antibodies developed for this purpose (Weber 2006, Son 2015, Monsion 2018), such as the dsRNA-specific monoclonal antibody mAb J2 (Schönborn 1991, Zangger 2013, available from Millipore Sigma, Burlington, MA) or commercially available kits (sold by Cisbio).

The ability of RNA produced by an RNA polymerase in an in vitro transcription reaction to serve as template for synthesis of active protein requires that a protein be encoded by the DNA molecule that serves as a template for RNA synthesis. For example, if the template contains the open reading frame encoding a gene or enzyme which is detected biochemically or enzymatically, then an in vitro translation system is used to translate the RNA generated in vitro and the completed translation reaction assayed to detect the protein encoded by the template. For example, if the template DNA molecule encodes a firefly luciferase enzyme, then RNA produced from a specific template molecule by an RNA polymerase is translated in a suitable in vitro translation system (for example translation systems based on extracts prepared from wheat germ or from rabbit reticulocytes), and the completed translation reaction assayed for luciferase activity.

The propensity of an RNA synthesized by an RNA polymerase from a DNA template that encodes a protein to be translated into active protein is dependent on the qualities of the RNA polymerase and the degree to which the RNA polymerase is capable of generating full-length transcripts that contain the entire protein coding sequence, the transcriptional fidelity of the RNA polymerase and the absence of additional transcribed sequences that may inhibit translation of the RNA. This propensity is referred to as the translational capacity of the RNA. Translational capacity can be measured by in vitro translation of an RNA or by in vivo translation of the RNA after introducing it into a cell or organism. RNA polymerases that synthesize RNAs with high translational capacity are desirable because the ultimate utility of an RNA is to direct synthesis of an active protein encoded by the RNA. While some polymerases efficiently generate RNA in vitro from a DNA template, this RNA may have low translational capacity which lowers the value and utility of the RNA polymerase.

The protein sequences of the RNA polymerases described in this disclosure are given in SEQ ID NO: 1 to 41. The same protein sequences, joined to a His6 N-terminal tag and a short Gly-Ser linker sequence, are given in SEQ ID NO: 42 to 82. The promoter sequences recognized by these enzymes are given in SEQ ID NO: 83 to 123. The RNA polymerases encoded by Cyanophage SynS (SEQ ID NO: 9 and 50), *Salmonella* virus SP6 (SEQ ID NO: 16 and 57), *Enterobacteria* phage T3 (SEQ ID NO: 35 and 76) and especially *Escherichia* phage T7 (SEQ ID NO: 41 and 82) have been previously isolated and characterized and represent known control RNA polymerases among the enzymes described in this disclosure (Butler 1982, McGraw 1985, Studier 1986, Zhu 2013, Zhu 2014).

The sequences of template molecules for the enzymes described in this disclosure and containing, from the 5' to the 3' end, the promoter sequences, a 5' UTR, a Shine-Delgarno sequence, an open reading frame encoding firefly luciferase and the bacteriophage lambda t1 terminator are given in SEQ ID NO: 124 to 164. The length of the template molecules given in SEQ ID NO: 124-164 ranges between 1815 and 1845 bp in length and the RNAs encoded by each are roughly 1800 bases in length. The identities of each promoter and template sequence in terms of their correspondence to each of the enzymes listed in SEQ ID NO: 1-82 are given in Table 1 below.

TABLE 1

SEQ ID NOs of all 41 RNA polymerases, promoter elements and template molecules

| Organism | RNApol SEQ ID NO | His-tagged RNApol SEQ ID NO | Promoter SEQ ID NO | Template SEQ ID NO |
|---|---|---|---|---|
| *Yersinia* phage phiR8-01 | 1 | 42 | 83 | 124 |
| *Aeromonas* phage phiAS7 | 2 | 43 | 84 | 125 |
| *Aquamicrobium* phage P14 | 3 | 44 | 85 | 126 |
| *Caulobacter* phage Percy | 4 | 45 | 86 | 127 |
| *Xanthomonas* phage f30-Xaj | 5 | 46 | 87 | 128 |
| *Burkholderia* phage Bp-AMP4 | 6 | 47 | 88 | 129 |
| *Pseudomonas* phage Bf7 | 7 | 48 | 89 | 130 |
| *Pseudomonas* phage Andromeda | 8 | 49 | 90 | 131 |
| Cyanophage Syn5 | 9 | 50 | 91 | 132 |
| *Pantoea* phage LIMEzero | 10 | 51 | 92 | 133 |
| *Acinetobacter* phage Petty | 11 | 52 | 93 | 134 |
| *Pantoea* phage LIMElight | 12 | 53 | 94 | 135 |
| *Erwinia amylovora* phage Era103 | 13 | 54 | 95 | 136 |
| *Proteus* phage vB_PmiP_Pm5460 | 14 | 55 | 96 | 137 |
| *Proteus* phage PM 93 | 15 | 56 | 97 | 138 |
| *Salmonella* virus SP6 | 16 | 57 | 98 | 139 |
| Lelliottia phage phD2B | 17 | 58 | 99 | 140 |
| *Escherichia* phage ECBP5 | 18 | 59 | 100 | 141 |
| *Delftia* phage IME-DE1 | 19 | 60 | 101 | 142 |
| *Pseudomonas* phage phi15 | 20 | 61 | 102 | 143 |
| *Vibrio* phage VP3 | 21 | 62 | 103 | 144 |
| *Vibrio*phage VP4 | 22 | 63 | 104 | 145 |
| *Vibrio* phage ICP3_2008_A | 23 | 64 | 105 | 146 |
| *Vibrio* phage ICP3_2007_A | 24 | 65 | 106 | 147 |
| *Vibrio* phage N4 | 25 | 66 | 107 | 148 |
| Cronobacter phage Dev2 | 26 | 67 | 108 | 149 |
| *Escherichia* phage vB_EcoP_GA2A | 27 | 68 | 109 | 150 |
| Enterobacteria phage EcoDS1 | 28 | 69 | 110 | 151 |
| *Morganella* phage vB_MmoP_MP2 | 29 | 70 | 111 | 152 |
| *Yersinia* phage Yepe2 | 30 | 71 | 112 | 153 |
| *Kluyvera* phage Kvp1 | 31 | 72 | 113 | 154 |
| *Klebsiella* phage K11 | 32 | 73 | 114 | 155 |
| *Klebsiella* phage KP32 | 33 | 74 | 115 | 156 |
| *Klebsiella* phage vB_KpnP_KpV766 | 34 | 75 | 116 | 157 |
| Enterobacteria phage T3 | 35 | 76 | 117 | 158 |
| *Serratia* phage SM9-3Y | 36 | 77 | 118 | 159 |
| *Yersinia* phage YpP-R | 37 | 78 | 119 | 160 |
| *Pectobacterium* phage PP99 | 38 | 79 | 120 | 161 |
| *Aeromonas* phage 25AhydR2PP | 39 | 80 | 121 | 162 |
| *Stenotrophomonas* phage IME15 | 40 | 81 | 122 | 163 |
| *Escherichia* phage T7 | 41 | 82 | 123 | 164 |

EXAMPLES

Example 1: Recombinant RNA Polymerase Expression in *E. coli*

RNA polymerase genes are designed with six histidine tag at their N-terminus (for example as in SEQ. ID. NOs 42-82) and cloned on a bacterial plasmid with an pMB1 plasmid replicon conferring high copy number in *E. coli*. The plasmid has an arabinose inducible promoter and a Lambda T1 terminator. *E. coli* strain BL21 is transformed with the expression plasmid and a single colony picked for cultivation and protein expression. The bacterial cells are grown in LB medium at 37° C. to log phase culture and induced by addition of L-arabinose. After 5 hours of induction, the cultures are harvested by centrifugation and the collected *E. coli* cells are lysed by lysozyme treatment and sonication. RNA polymerase is purified with nickel affinity chromatography according to the metal resin manufacturer's instructions (Qiagen, Germany) The RNA polymerase is eluted with 250 mM imidazole solution, concentrated with Amicon Ultra-centrifugal filter (EMD Millipore, Burlington, MA, USA) and changed into a storage buffer composed of 50 mM Tris pH 8.0, 75 mM NaCl, 0.1 mM EDTA, 10 mM (β-mercaptoethanol and 50% glycerol.

Example 2: Recombinant RNA Polymerase Expression In Vitro Using Cell-Free Extracts A T7 promoter and T7 terminator are added by PCR to the 5' and 3' ends, respectively, of a full-length open reading frame encoding an RNA polymerase, using primers encoding the T7 promoter and T7 terminator, respectively, to create an expression cassette suitable for in vitro protein expression. The PCR fragment is added to a commercially available *E. coli*-based in vitro transcription and translation extract sold by Fisher Scientific. After incubation for protein expression according to the manufacturer's instructions, the protein mixture is harvested and centrifuged. RNA polymerase is purified from the supernatant with nickel affinity chromatography according to the metal resin manufacturer's instruction (Qiagen, Germany) The RNA polymerase is eluted with imidazole solution, concentrated with Amicon Ultra-centrifugal filter (EMD Millipore, Burlington, MA, USA) and changed into a storage buffer composed of 50 mM Tris pH 8.0, 75 mM NaCl, 0.1 mM EDTA, 10 mM (β-mercaptoethanol and 50% glycerol.

Example 3: Characterization of RNAs Produced with Different RNA Polymerases by In Vitro Transcription The RNA polymerases tested in this example are compared to known RNA polymerases encoded by Cyanophage SynS (SEQ ID NO: 9 and 50), *Salmonella* virus SP6 (SEQ ID NO: 16 and 57), *Enterobacteria* phage T3 (SEQ ID NO: 35 and 76) and especially *Escherichia* phage T7 (SEQ ID NO: 41 and 82) which serve as controls in the datasets given below (Butler 1982, McGraw 1985, Studier 1986, Zhu 2013, Zhu 2014).

RNA is synthesized using a purified RNA polymerase at its permissive temperatures ranging from 18° C. to 50° C. A 20 μl in vitro transcription reaction using normal nucleotides is composed of 40 mM Tris buffer, pH 7.9 at 25° C., 6 mM MgCl2, 5 mM DTT, 1 mM of each NTP (ATP, CTP, GTP and UTP each), 1 μg of RNA polymerase protein, 400 ng of a linear, double-stranded DNA template and RNAase inhibitor (1U/ul). The linear, double-stranded DNA template has a promoter specific for the RNA polymerase near its 5' end and upstream of an open reading frame encoding a firefly luciferase enzyme. The sequences of the DNA template molecules for each RNA polymerase are given in SEQ ID NO: 124-164, and the RNA transcribed from each is approximately 1800 nucleotides in length from transcription start site to the 3' end of the molecule.

Alternatively, a 20 μl in vitro transcription reaction is composed of 40 mM Tris buffer, pH 7.9 at 25° C., 6 mM MgCl2, 5 mM DTT, 1 mM of each NTP (ATP, CTP, GTP and UTP, with one NTP substituted for a modified nucleotide triphosphate), 1 μg of RNA polymerase protein, 400 ng of a linear, double-stranded DNA template and RNAase inhibitor (1 U/ul). Modified nucleotide triphosphates include but are not limited to compounds such as 2'-O -methyl NTPs, 2'-fluoro NTPs, pseudouridine-5'-triphosphate, N1-methylpseudouridine-5'-triphosphate and 5-methyl-cytidine-5'-triphosphate, which are either substituted for the corresponding NTP, or are added to the reaction replacing 50%-90% of the corresponding NTP.

The linear DNA template is generated by PCR reactions with the 5' primer encoding a promoter sequence specific for the RNA polymerase.

Figure 1B:
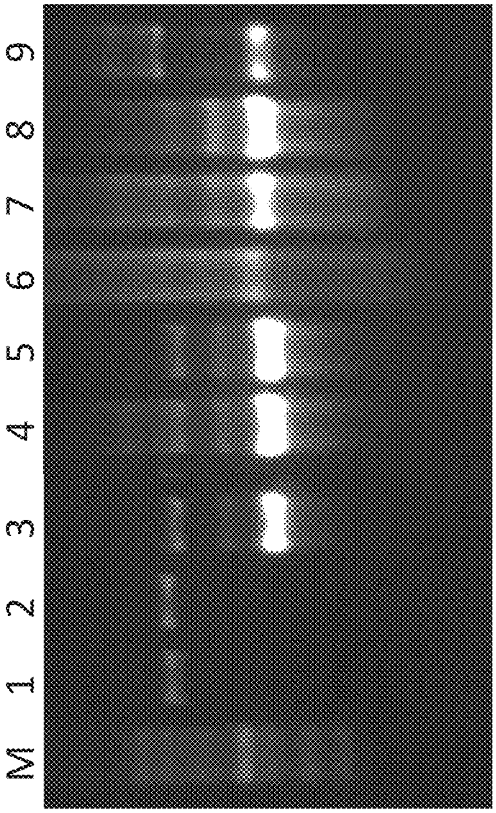

The in vitro transcription reaction is incubated at its permissive temperature for 2 hours. A 3 μl-10 μl aliquot of the reaction is electrophoresed on a 1% agarose gel together with RNA markers to visualize the synthesized RNA and estimate its size. Size uniformity of the RNA is assessed qualitatively on a scale from 1 to 4 from the intensity of the primary RNA band and any higher- or lower-molecular weight smears surrounding it, with a score of 1 being lower size uniformity and a score of 4 higher size uniformity. The remainder of the reaction is treated with DNAse I and electrophoresed in the same manner to clearly establish the identity of specific bands on the gel as RNA molecules. Examples of in vitro synthesized RNAs electrophoresed on agarose gels are shown in FIG. 1A and FIG. 1B.

To measure RNA yields resulting from in vitro transcription reaction, RNA generated using in vitro transcription reactions is purified using commercially available silica-based resins and eluted in low-salt Tris buffer. Specifically, the RNA Clean & Concentrator kit sold by Zymo Research Corporation (Irvine, CA, USA) is used according to the manufacturer's instructions. The concentration of the eluted RNA is determined using a NanoDrop™ One/OneC Microvolume UV-Vis Spectrophotometer (Thermo Fisher Scientific) and total RNA yields are calculated by multiplying the RNA concentration by the volume of recovered RNA. Percentages of theoretical yields are calculated by dividing the RNA yield by 25.7 μg (the combined weights of 20 nmol each (1 mM×20 μl) of AMP, CMP, GMP and UMP incorporated into RNA, using 329.2 g/mol for AMP, 305.2 g/mol for CMP, 345.2 g/mol for GMP and 306.2 g/mol for UMP) and converting to percentages.

A dot blot assay is used to determine double-stranded RNA (dsRNA) levels. RNA is spotted onto super-charged Nytran membrane (Millipore Sigma, Burlington, MA), dried, blocked with 5% non-fat dry milk in TBST buffer (50 mM Tris-Hcl, 150 mM NaCl, 0.05% Tween-20, pH7.4), and incubated with dsRNA-specific monoclonal antibody mAb J2 (Schönborn 1991, Zangger 2013, available from Millipore Sigma, Burlington, MA, USA) for 60 min. Membranes are washed 4 times with TBST and reacted with HRP conjugated secondary antibody, washed 5 times with TBST and detected with ECL Plus Western blot detection reagent (Millipore Sigma, Burlington, MA, USA). Images are captured with an Azure 600 digital imaging system (Azure Biosytems, Dublin, CA, USA). To determine the correspondence between signal intensity and dsRNA amounts in each sample, sense and antisense RNAs are produced using the same template sequence, quantitated with a NanoDrop™ One/OneC Microvolume UV-Vis Spectrophotometer (Thermo Fisher Scientific), combined in equal amounts and annealed in vitro, and different amounts tested in the dot blot assay. Such a quantitative experiment established the following relationship between dsRNA amounts and dot blot signal intensity: 50 ng dsRNA: high signal; 17 ng dsRNA: medium signal; 6 ng dRNA: low signal; 2 ng dsRNA: low signal.

To measure the translational capacity of in vitro transcribed RNA, the mRNA encoding firefly luciferase produced by the in vitro transcription reaction and purified with the RNA Clean & Concentrator kit (Zymo Research Corporation, Irvine, CA, USA) is translated in vitro and enzyme activity measured. One μg mRNA is added to a 20 μl in vitro translation reaction mediated by wheat germ cell-free extracts (Promega Corporation, Madison, WI, USA), according to the manufacturer's instructions. Five microliters of the in vitro translation reaction is mixed with luciferin substrate (Promega Corporation, Madison, WI, USA) and the bioluminescence is measured on a micro-titer plate reader (BioTek, Winooski, VT, USA). Translation capacity of the RNA polymerase is calculated as the percentage of the bioluminescence produced by the RNA polymerase mRNA divided by the control mRNA provided in the wheat germ in vitro translation kit.

Activities of the 41 RNA polymerases are summarized in Table 2 and Table 3. N.T.=Not Tested.

TABLE 2A

RNA yields and double-stranded RNA levels of RNAs transcribed in vitro with different RNA polymerases (absolute yields)

| Organism | His-tagged RNApol SEQ ID NO | RNA yield (μg, with natural NTPs) 18° C. | 24° C. | 37° C. | Double-stranded RNA (24° C.) | Size uniformity |
|---|---|---|---|---|---|---|
| *Yersinia* phage phiR8-01 | 42 | 13.7 | 11.9 | 9.9 | low | 4 |
| *Aeromonas* phage phiAS7 | 43 | 17.0 | 13.8 | 18.6 | low | 4 |
| *Aquamicrobium* phage P14 | 44 | 0.0 | 0.8 | 1.9 | low | 2 |
| *Caulobacter* phage Percy | 45 | 3.7 | 6.2 | 8.2 | medium | 2 |
| *Xanthomonas* phage f30-Xaj | 46 | 12.9 | 12.0 | 8.8 | low | 4 |
| *Burkholderia* phage Bp-AMP4 | 47 | 3.2 | 6.1 | 7.9 | low | 2 |
| *Pseudomonas* phage Bf7 | 48 | 4.1 | 8.2 | 1.1 | low | 4 |
| *Pseudomonas* phage Andromeda | 49 | 17.2 | 14.8 | 11.9 | low | 4 |
| Cyanophage Syn5 | 50 | N.T. | 1.4 | 0.3 | medium | 2 |
| *Pantoea* phage LIMEzero | 51 | 0.2 | 0.1 | 0.4 | N.T. | 1 |
| *Acinetobacter* phage Petty | 52 | 0.0 | 0.8 | 1.7 | N.T. | 2 |
| *Pantoea* phage LIMElight | 53 | 5.6 | 7.4 | 4.7 | medium | 4 |
| *Erwinia amylovora* phage Era103 | 54 | N.T. | 17.5 | 11.3 | low | 4 |
| *Proteus* phage vB PmiP Pm5460 | 55 | 18.3 | 16.1 | 12.8 | low | 4 |
| *Proteus* phage PM 93 | 56 | 11.1 | 7.2 | 9.5 | high | 4 |
| *Salmonella* virus SP6 | 57 | 11.8 | 12.3 | 12.3 | medium | 4 |
| Lelliottia phage phD2B | 58 | 18.7 | 9.2 | 11.7 | low | 4 |
| *Escherichia* phage ECBP5 | 59 | 15.9 | 13.7 | 9.4 | low | 4 |
| *Delftia* phage IME-DE1 | 60 | 20.2 | 13.4 | 13.8 | low | 4 |
| *Pseudomonas* phage phi15 | 61 | 14.7 | 7.9 | 12.4 | low | 4 |
| *Vibrio* phage VP3 | 62 | 17.3 | 7.2 | 10.3 | low | 4 |
| *Vibrio*phage VP4 | 63 | 12.4 | 14.5 | 17.8 | low | 3 |
| *Vibrio* phage ICP3__2008__A | 64 | 5.1 | 4.2 | 7.9 | medium | 1 |
| *Vibrio* phage ICP3__2007__A | 65 | 1.1 | 5.2 | 3.4 | low | 2 |
| *Vibrio* phage N4 | 66 | 21.2 | 16.5 | 13.8 | low | 4 |
| Cronobacter phage Dev2 | 67 | 1.1 | 6.1 | 4.6 | low | 1 |
| *Escherichia* phage vB__EcoP__GA2A | 68 | 11.2 | 7.3 | 10.0 | low | 4 |
| Enterobacteria phage EcoDS1 | 69 | 8.2 | 5.2 | 8.8 | medium | 3 |
| *Morganella* phage vB MmoP MP2 | 70 | 18.4 | 19.1 | 11.1 | high | 4 |
| *Yersinia* phage Yepe2 | 71 | 7.1 | 5.8 | 5.8 | medium | 1 |
| *Kluyvera* phage Kvp1 | 72 | 4.6 | 4.1 | 4.7 | medium | 1 |
| *Klebsiella* phage K11 | 73 | 12.5 | 7.7 | 9.6 | high | 3 |
| *Klebsiella* phage KP32 | 74 | 11.2 | 8.1 | 8.1 | high | 4 |
| *Klebsiella* phage vB KpnP KpV766 | 75 | 14.8 | 9.6 | 9.1 | high | 2 |
| Enterobacteria phage T3 | 76 | 4.1 | 6.3 | 6.1 | medium | 3 |
| *Serratia* phage SM9-3Y | 77 | 5.7 | 9.2 | 12.3 | medium | 4 |
| *Yersinia* phage YpP-R | 79 | 6.8 | 8.3 | 9.2 | high | 2 |
| *Pectobacterium* phage PP99 | 80 | 10.7 | 13.7 | 4.6 | low | 4 |
| *Aeromonas* phage 25AhydR2PP | 81 | 2.1 | 3.0 | 0.3 | high | 2 |
| *Stenotrophomonas* phage IME15 | 82 | 13.0 | 18.4 | 13.8 | medium | 4 |
| T7 bacteriophage (control) | — | 3.5 | 12.0 | 10.0 | high | 3 |

TABLE 2B

RNA yields and double-stranded RNA levels of RNAs transcribed in vitro with different RNA polymerases (% of theoretical yields)

| Organism | His-tagged RNApol SEQ ID NO | RNA yield (μg, with natural NTPs) 18° C. | 24° C. | 37° C. | Double-stranded RNA (24° C.) | Size uniformity |
|---|---|---|---|---|---|---|
| *Yersinia* phage phiR8-01 | 42 | 53% | 46% | 38% | low | 4 |
| *Aeromonas* phage phiAS7 | 43 | 66% | 54% | 72% | low | 4 |
| *Aquamicrobium* phage P14 | 44 | 0% | 3% | 7% | low | 2 |
| *Caulobacter* phage Percy | 45 | 14% | 24% | 32% | medium | 2 |
| *Xanthomonas* phage f30-Xaj | 46 | 50% | 47% | 34% | low | 4 |
| *Burkholderia* phage Bp-AMP4 | 47 | 12% | 24% | 31% | low | 2 |
| *Pseudomonas* phage Bf7 | 48 | 16% | 32% | 4% | low | 4 |
| *Pseudomonas* phage Andromeda | 49 | 67% | 58% | 46% | low | 4 |
| Cyanophage Syn5 | 50 | N.T. | 5% | 1% | medium | 2 |
| *Pantoea* phage LIMEzero | 51 | 1% | 0% | 2% | N.T. | 1 |
| *Acinetobacter* phage Petty | 52 | 0% | 3% | 7% | N.T. | 2 |
| *Pantoea* phage LIMElight | 53 | 22% | 29% | 18% | medium | 4 |

TABLE 2B-continued

RNA yields and double-stranded RNA levels of RNAs transcribed in vitro with different RNA polymerases (% of theoretical yields)

| Organism | His-tagged RNApol SEQ ID NO | RNA yield (µg, with natural NTPs) 18° C. | 24° C. | 37° C. | Double-stranded RNA (24° C.) | Size uniformity |
|---|---|---|---|---|---|---|
| *Erwinia amylovora* phage Era103 | 54 | N.T. | 68% | 44% | low | 4 |
| *Proteus* phage vB PmiP Pm5460 | 55 | 71% | 63% | 50% | low | 4 |
| *Proteus* phage PM 93 | 56 | 43% | 28% | 37% | high | 4 |
| *Salmonella* virus SP6 | 57 | 46% | 48% | 48% | medium | 4 |
| Lelliottia phage phD2B | 58 | 73% | 36% | 45% | low | 4 |
| *Escherichia* phage ECBP5 | 59 | 62% | 53% | 37% | low | 4 |
| *Delftia* phage IME-DE1 | 60 | 79% | 52% | 54% | low | 4 |
| *Pseudomonas* phage phi15 | 61 | 57% | 31% | 48% | low | 4 |
| *Vibrio* phage VP3 | 62 | 67% | 28% | 40% | low | 4 |
| *Vibrio*phage VP4 | 63 | 48% | 57% | 69% | low | 3 |
| *Vibrio* phage ICP3__2008__A | 64 | 20% | 16% | 31% | medium | 1 |
| *Vibrio* phage ICP3__2007__A | 65 | 4% | 20% | 13% | low | 2 |
| *Vibrio* phage N4 | 66 | 82% | 64% | 54% | low | 4 |
| Cronobacter phage Dev2 | 67 | 4% | 24% | 18% | low | 1 |
| *Escherichia* phage vB__EcoP__GA2A | 68 | 44% | 28% | 39% | low | 4 |
| Enterobacteria phage EcoDS 1 | 69 | 32% | 20% | 34% | medium | 3 |
| *Morganella* phage vB MmoP MP2 | 70 | 72% | 74% | 43% | high | 4 |
| *Yersinia* phage Yepe2 | 71 | 28% | 23% | 23% | medium | 1 |
| *Kluyvera* phage Kvp1 | 72 | 18% | 16% | 18% | medium | 1 |
| *Klebsiella* phage K11 | 73 | 49% | 30% | 37% | high | 3 |
| *Klebsiella* phage KP32 | 74 | 44% | 31% | 31% | high | 4 |
| *Klebsiella* phage vB KpnP KpV766 | 75 | 58% | 37% | 35% | high | 2 |
| Enterobacteria phage T3 | 76 | 16% | 25% | 24% | medium | 3 |
| *Serratia* phage SM9-3Y | 77 | 22% | 36% | 48% | medium | 4 |
| *Yersinia* phage YpP-R | 79 | 26% | 32% | 36% | high | 2 |
| *Pectobacterium* phage PP99 | 80 | 42% | 53% | 18% | low | 4 |
| *Aeromonas* phage 25AhydR2PP | 81 | 8% | 12% | 1% | high | 2 |
| *Stenotrophomonas* phage IME15 | 82 | 50% | 72% | 54% | medium | 4 |
| T7 bacteriophage (control) | — | 14% | 47% | 39% | high | 3 |

TABLE 3A

RNA yields and translational capacity of RNAs transcribed in vitro with different RNA polymerases (absolute yields)

| Organism | RNApol SEQ ID NO | His-tagged RNApol SEQ ID NO | RNA yield (µg, with modified nucleotides) Pseudo-UTP | 5-Methyl-CTP | Translational capacity (24° C.) |
|---|---|---|---|---|---|
| *Yersinia* phage phiR8-01 | 1 | 42 | 9.1 | 9.3 | 116% |
| *Aeromonas* phage phiAS7 | 2 | 43 | 8.9 | 8.9 | 103% |
| *Aquamicrobium* phage P14 | 3 | 44 | 0.3 | 0.6 | 17% |
| *Caulobacter* phage Percy | 4 | 45 | N.T. | 1.8 | 42% |
| *Xanthomonas* phage f30-Xaj | 5 | 46 | 0.6 | 3.7 | 92% |
| *Burkholderia* phage Bp-AMP4 | 6 | 47 | 0.3 | 1.5 | 99% |
| *Pseudomonas* phage Bf7 | 7 | 48 | 1.7 | 3.1 | 63% |
| *Pseudomonas* phage Andromeda | 8 | 49 | 5.0 | 8.0 | 105% |
| Cyanophage Syn5 | 9 | 50 | 0.6 | 0.8 | 74% |
| *Pantoea* phage LIMEzero | 10 | 51 | 0.2 | 0.1 | N.T. |
| *Acinetobacter* phage Petty | 11 | 52 | 0.4 | 0.2 | N.T. |
| *Pantoea* phage LIMElight | 12 | 53 | 3.1 | 7.0 | 9% |
| *Erwinia amylovora* phage Era103 | 13 | 54 | 6.2 | 8.6 | 60% |
| *Proteus* phage vB PmiP Pm5460 | 14 | 55 | 7.1 | 10.2 | 118% |
| *Proteus* phage PM 93 | 15 | 56 | 11.7 | 5.6 | 63% |
| *Salmonella* virus SP6 | 16 | 57 | 0 | 11.7 | 80% |
| Lelliottia phage phD2B | 17 | 58 | 11.5 | 9.4 | 118% |
| *Escherichia* phage ECBP5 | 18 | 59 | 7.5 | 11.4 | 93% |
| *Delftia* phage IME-DE1 | 19 | 60 | 9.4 | 10.4 | 23% |
| *Pseudomonas* phage phi15 | 20 | 61 | 8.9 | 10.6 | 138% |
| *Vibrio* phage VP3 | 21 | 62 | 10.8 | 10.1 | 66% |
| *Vibrio*phage VP4 | 22 | 63 | 14.8 | 3.8 | 36% |
| *Vibrio* phage ICP3_2008_A | 23 | 64 | 1.5 | 4.8 | 18% |
| *Vibrio* phage ICP3_2007_A | 24 | 65 | 0.3 | 0.1 | 15% |
| *Vibrio* phage N4 | 25 | 66 | 9.8 | 10.3 | 59% |
| Cronobacter phage Dev2 | 26 | 67 | 3.5 | 0.6 | 3% |
| *Escherichia* phage vB_EcoP_GA2A | 27 | 68 | 5.4 | 10.1 | 75% |
| Enterobacteria phage EcoDS1 | 28 | 69 | 4 | 7.5 | 34% |

TABLE 3A-continued

RNA yields and translational capacity of RNAs transcribed in vitro with different RNA polymerases (absolute yields)

| Organism | RNApol SEQ ID NO | His-tagged RNApol SEQ ID NO | RNA yield (μg, with modified nucleotides) Pseudo-UTP | 5-Methyl-CTP | Translational capacity (24° C.) |
|---|---|---|---|---|---|
| *Morganella* phage vB MmoP MP2 | 29 | 70 | 8.4 | 9.3 | 73% |
| *Yersinia* phage Yepe2 | 30 | 71 | 2.4 | 2.9 | 26% |
| *Kluyvera* phage Kvp1 | 31 | 72 | 0.7 | 2.4 | N.T. |
| *Klebsiella* phage K11 | 32 | 73 | 9.2 | 8.3 | 29% |
| *Klebsiella* phage KP32 | 33 | 74 | 3.3 | 8.6 | 4% |
| *Klebsiella* phage vB KpnP KpV766 | 34 | 75 | 5.8 | 4.8 | 13% |
| Enterobacteria phage T3 | 35 | 76 | 3.1 | 3.3 | 7% |
| *Serratia* phage SM9-3Y | 36 | 77 | 5.4 | 6.1 | 27% |
| *Yersinia* phage YpP-R | 38 | 79 | 4.6 | 4.0 | 31% |
| *Pectobacterium* phage PP99 | 39 | 80 | 10.4 | 5.8 | 63% |
| *Aeromonas* phage 25AhydR2PP | 40 | 81 | 1.7 | 1.0 | 36% |
| *Stenotrophomonas* phage IME15 | 41 | 82 | 8.1 | 6.5 | 60% |
| T7 bacteriophage (control) | — | — | 4.8 | 5.8 | 32% |

TABLE 3B

RNA yields and translational capacity of RNAs transcribed in vitro with different RNA polymerases (% of theoretical yields)

| Organism | RNApol SEQ ID NO | His-tagged RNApol SEQ ID NO | RNA yield (μg, with modified nucleotides) Pseudo-UTP | 5-Methyl-CTP | Translational capacity (24° C.) |
|---|---|---|---|---|---|
| *Yersinia* phage phiR8-01 | 1 | 42 | 35% | 36% | 116% |
| *Aeromonas* phage phiAS7 | 2 | 43 | 35% | 35% | 103% |
| *Aquamicrobium* phage P14 | 3 | 44 | 1% | 2% | 17% |
| *Caulobacter* phage Percy | 4 | 45 | N.T. | 7% | 42% |
| *Xanthomonas* phage f30-Xaj | 5 | 46 | 2% | 14% | 92% |
| *Burkholderia* phage Bp-AMP4 | 6 | 47 | 1% | 6% | 99% |
| *Pseudomonas* phage Bf7 | 7 | 48 | 7% | 12% | 63% |
| *Pseudomonas* phage Andromeda | 8 | 49 | 19% | 31% | 105% |
| Cyanophage Syn5 | 9 | 50 | 2% | 3% | 74% |
| *Pantoea* phage LIMEzero | 10 | 51 | 1% | 0% | N.T. |
| *Acinetobacter* phage Petty | 11 | 52 | 2% | 1% | N.T. |
| *Pantoea* phage LIMElight | 12 | 53 | 12% | 27% | 9% |
| *Erwinia amylovora* phage Era103 | 13 | 54 | 24% | 33% | 60% |
| *Proteus* phage vB PmiP Pm5460 | 14 | 55 | 28% | 40% | 118% |
| *Proteus* phage PM 93 | 15 | 56 | 45% | 22% | 63% |
| *Salmonella* virus SP6 | 16 | 57 | 0% | 45% | 80% |
| Lelliottia phage phD2B | 17 | 58 | 45% | 37% | 118% |
| *Escherichia* phage ECBP5 | 18 | 59 | 29% | 44% | 93% |
| *Delftia* phage IME-DE1 | 19 | 60 | 37% | 40% | 23% |
| *Pseudomonas* phage phi15 | 20 | 61 | 35% | 41% | 138% |
| *Vibrio* phage VP3 | 21 | 62 | 42% | 39% | 66% |
| *Vibrio*phage VP4 | 22 | 63 | 58% | 15% | 36% |
| *Vibrio* phage ICP3_2008_A | 23 | 64 | 6% | 19% | 18% |
| *Vibrio* phage ICP3_2007_A | 24 | 65 | 1% | 0% | 15% |
| *Vibrio* phage N4 | 25 | 66 | 38% | 40% | 59% |
| Cronobacter phage Dev2 | 26 | 67 | 14% | 2% | 3% |
| *Escherichia* phage vB_EcoP_GA2A | 27 | 68 | 21% | 39% | 75% |
| Enterobacteria phage EcoDS1 | 28 | 69 | 16% | 29% | 34% |
| *Morganella* phage vB MmoP MP2 | 29 | 70 | 33% | 36% | 73% |
| *Yersinia* phage Yepe2 | 30 | 71 | 9% | 11% | 26% |
| *Kluyvera* phage Kvp1 | 31 | 72 | 3% | 9% | N.T. |
| *Klebsiella* phage K11 | 32 | 73 | 36% | 32% | 29% |
| *Klebsiella* phage KP32 | 33 | 74 | 13% | 33% | 4% |
| *Klebsiella* phage vB KpnP KpV766 | 34 | 75 | 23% | 19% | 13% |
| Enterobacteria phage T3 | 35 | 76 | 12% | 13% | 7% |
| *Serratia* phage SM9-3Y | 36 | 77 | 21% | 24% | 27% |
| *Yersinia* phage YpP-R | 38 | 79 | 18% | 16% | 31% |
| *Pectobacterium* phage PP99 | 39 | 80 | 40% | 23% | 63% |
| *Aeromonas* phage 25AhydR2PP | 40 | 81 | 7% | 4% | 36% |
| *Stenotrophomonas* phage IME15 | 41 | 82 | 31% | 25% | 60% |
| T7 bacteriophage (control) | — | — | 19% | 23% | 32% |

REFERENCES

Andries O, Mc Cafferty S, De Smedt S C, Weiss R, Sanders N N, Kitada T (2015). N(1)-methylpseudouridine-incorporated mRNA outperforms pseudouridine-incorporated mRNA by providing enhanced protein expression and reduced immunogenicity in mammalian cell lines and mice. J Control Release 217:337-344.

Arai R, Ueda H, Kitayama A, Kamiya N, Nagamune T (2001). Design of the linkers which effectively separate domains of a bifunctional fusion protein. Protein Engineering 14 (8): 529-532.

Bagdasarian M, Lurz R, Rückert B, Franklin F C, Bagdasarian M M, Frey J, Timmis K N (1981). Specific-purpose plasmid cloning vectors. II. Broad host range, high copy number, RSF1010-derived vectors, and a host-vector system for gene cloning in *Pseudomonas*. Gene 16(1-3):237-247.

Burnett J C, Rossi J J, Tiemann K (2011). Current progress of siRNA/shRNA therapeutics in clinical trials. Biotechnol J. 6(9):1130-1146.

Butler E T, Chamberlin M J (1982). Bacteriophage SP6-specific RNA polymerase. I. Isolation and characterization of the enzyme. J Biol Chem. 257(10):5772-5778.

Chang A C, Cohen S N (1978). Construction and characterization of amplifiable multicopy DNA cloning vehicles derived from the PI5A cryptic miniplasmid. J Bacteriol. 134(3):1141-1156.

Chelliserrykattil J, Ellington A D (2004). Evolution of a T7 RNA polymerase variant that transcribes 2'-O-methyl RNA. Nat Biotechnol. 22(9):1155-1160.

Ge Q, Dallas A, Ilves H, Shorenstein J, Behlke M A, Johnston B H (2010). Effects of chemical modification on the potency, serum stability, and immunostimulatory properties of short shRNAs. RNA 16(1):118-130.

Darzynkiewicz E, Stepinski J, Ekiel I, Jin Y, Haber D, Sijuwade T, Tahara S M (1988). Beta-globin mRNAs capped with m7G, m2.7(2)G or m2.2.7(3)G differ in intrinsic translation efficiency. Nucleic Acids Res. 16(18): 8953-62.

Gholamalipour Y, Karunanayake M A, Martin C T (2018). 3' end additions by T7 RNA polymerase are RNA self-templated, distributive and diverse in character—RNA-Seq analyses. Nucleic Acids Res.; 46(18):9253-9263.

Gibson D G, Young L, Chuang R Y, Venter J C, Hutchison C A 3rd, Smith H O (2009). Enzymatic assembly of DNA molecules up to several hundred kilobases. Nat Methods. 6(5):343-345.

Gibson D G, Smith H O, Hutchison C A 3rd, Venter J C, Merryman C (2010). Chemical synthesis of the mouse mitochondrial genome. Nat Methods. 7(11):901-903.

Ibach J, Dietrich L, Koopmans K R, Nöbel N, Skoupi M, Brakmann S (2013). Identification of a T7 RNA polymerase variant that permits the enzymatic synthesis of fully 2'-O-methyl-modified RNA. J Biotechnol. 167(3): 287-295.

Imburgio D, Rong M, Ma K, McAllister W T (2000). Studies of promoter recognition and start site selection by T7 RNA polymerase using a comprehensive collection of promoter variants. Biochemistry 39(34):10419-10430.

Irwin C R, Farmer A, Willer D O, Evans D H (2012). In-fusion® cloning with vaccinia virus DNA polymerase. Methods Mol Biol. 890:23-35.

Jackson A L, Burchard J, Leake D, Reynolds A, Schelter J, Guo J, Johnson J M, Lim L, Karpilow J, Nichols K, Marshall W, Khvorova A, Linsley P S (2006). Position-specific chemical modification of siRNAs reduces "off-target" transcript silencing. RNA 12(7):1197-1205.

Jeong J, Cho N, Jung D, Bang D (2013). Genome-scale genetic engineering in *Escherichia coli*. Biotechnol Adv. 31(6):804-810.

KarikóK, Muramatsu H, Welsh F A, Ludwig J, Kato H, Akira S, Weissman D (2008). Incorporation of pseudouridine into mRNA yields superior nonimmunogenic vector with increased translational capacity and biological stability. Mol Ther. 16(11):1833-1840

Kole R, Krainer A R, Altman S (2012). RNA therapeutics: beyond RNA interference and antisense oligonucleotides. Nat Rev Drug Discov. 11(2):125-140.

Konarska M M, Padgett R A, Sharp P A (1984). Recognition of cap structure in splicing in vitro of mRNA precursors. Cell 38(3):731-736.

Kraynack B A, Baker B F (2005). Small interfering RNAs containing full 2'-0-methylribonucleotide-modified sense strands display Argonaute2/eIF2C2-dependent activity. RNA 12(1):163-176.

Layzer J M, McCaffrey A P, Tanner A K, Huang Z, Kay M A, Sullenger B A (2004). In vivo activity of nuclease-resistant siRNAs. RNA 10(5):766-771.

Lathe R, Kieny M P, Skory S, Lecocq J P (1984). Linker tailing: unphosphorylated linker oligonucleotides for joining DNA termini. DNA 3(2): 173-182

Leprince A, van Passel M W, dos Santos V A (2012). Streamlining genomes: toward the generation of simplified and stabilized microbial systems. Curr Opin Biotechnol. 23(5):651-658.

Li M Z, Elledge S J. (2007). Harnessing homologous recombination in vitro to generate recombinant DNA via SLIC. Nat Methods. 4(3): 251-256.

Li C, Wen A, Shen B, Lu J, Huang Y, Chang Y. (2011). FastCloning: a highly simplified, purification-free, sequence- and ligation-independent PCR cloning method. BMC Biotechnol. 11:92.

Li M Z, Elledge S J. (2012). SLIC: a method for sequence- and ligation-independent cloning. Methods Mol Biol. 852:51-59.

Lobban P E, Kaiser A D (1973). Enzymatic end-to end joining of DNA molecules. J Mol Biol. 78(3): 453-471.

Madyagol M, Al-Alami H, Levarski Z, Drahovská H, Turňia J, Stuchlík S (2011). Gene replacement techniques for *Escherichia coli* genome modification. *Folia Microbiol* (Praha) 56(3):253-263.

Majlessi M, Nelson N C, Becker M M (1998). Advantages of 2'-0-methyl oligoribonucleotide probes for detecting RNA targets. Nucleic Acids Res. 26(9):2224-2229.

McGraw N J, Bailey J N, Cleaves G R, Dembinski D R, Gocke C R, Joliffe L K, MacWright R S, McAllister W T (1985). Sequence and analysis of the gene for bacteriophage T3 RNA polymerase. Nucleic Acids Res. 13(18): 6753-6766.

Meyer R, Figurski D, Helinski D R (1975). Molecular vehicle properties of the broad host range plasmid R K2. Science 190(4220):1226-1228.

Meyer A J, Garry D J, Hall B, Byrom M M, McDonald H G, Yang X, Yin Y W, Ellington A D (2015). Transcription yield of fully 2'-modified RNA can be increased by the addition of thermostabilizing mutations to T7 RNA polymerase mutants. Nucleic Acids Res. 43(15):7480-7488.

Monsion B, Incarbone M, Hleibieh K, Poignavent V, Ghannam A, Dunoyer P, Daeffler L, Tilsner J, Ritzenthaler C (2018). Efficient detection of long dsRNA in vitro and in vivo using the dsRNA binding domain from FHV B2 Protein. Front Plant Sci. 9: 70.

Mu X, Greenwald E, Ahmad S, Hur S (2018). An origin of the immunogenicity of in vitro transcribed RNA. Nucleic Acids Res. 46(10): 5239-5249.

Padilla R, Sousa R (2002). A Y639F/H784A T7 RNA polymerase double mutant displays superior properties for synthesizing RNAs with non-canonical NTPs. Nucleic Acids Res. 30(24):e138.

Pardi N, Weissman D (2017). Nucleoside Modified mRNA Vaccines for Infectious Diseases. Methods Mol Biol. 1499:109-121.

Pasquinelli A E, Dahlberg J E, Lund E (1995). Reverse 5' caps in RNAs made in vitro by phage RNA polymerases. RNA 1(9):957-967.

Potapov V, Fu X, Dai N, Corrêa I R Jr, Tanner N A, Ong J L (2018). Base modifications affecting RNA polymerase and reverse transcriptase fidelity. Nucleic Acids Res. 46(11):5753-5763.

Quan J, Tian J (2009). Circular polymerase extension cloning of complex gene libraries and pathways. PLoS One. 4(7): e6441.

Quan J, Tian J (2011). Circular polymerase extension cloning for high-throughput cloning of complex and combinatorial DNA libraries. Nat Protoc. 6(2):242-251.

Regalado, A (2015). The Next Great GMO Debate. MIT Technology Review Aug. 11, 2015. Available on the technologyreview website.

Richter K, Gescher J (2012); The molecular toolbox for chromosomal heterologous multiprotein expression in *Escherichia coli. Biochem Soc Trans.* 40(6):1222-1226.

Rose R E (1988). The nucleotide sequence of pACYC184. Nucleic Acids Res. 16(1):355.

Rossbach M (2010). Small non-coding RNAs as novel therapeutics. Curr Mol Med. 10(4):361-368.

Sahin U, Karikó K, Türeci Ö (2014). mRNA-based therapeutics-developing a new class of drugs. Nat Rev Drug Discov. 13(10):759-780.

Sambrook, J., Fritsch, E. F., and Maniatis, T. (1989) Molecular Cloning: A Laboratory Manual, Second Ed., Cold Spring Harbor Laboratory Press, Plainview, N. Y.

Schmidhauser T J, Filutowicz M, Helinski D R (1983). Replication of derivatives of the broad host range plasmid RK2 in two distantly related bacteria. Plasmid 9(3):325-330.

Schmidhauser T J, Helinski D R (1985). Regions of broad-host-range plasmid RK2 involved in replication and stable maintenance in nine species of gram-negative bacteria. J Bacteriol. 164(1):446-455.

Schönborn J, Oberstrass J, Breyel E, Tittgen J, Schumacher J, Lukacs N (1991). Monoclonal antibodies to double-stranded RNA as probes of RNA structure in crude nucleic acid extracts. Nucleic Acids Res. 19(11):2993-3000.

Schweizer H (2008). Bacterial genetics: past achievements, present state of the field, and future challenges. Biotechniques 44(5):633-641.

Sergeeva O V, Koteliansky V E, Zatsepin T S (2016). mRNA-Based Therapeutics-Advances and Perspectives. Biochemistry (Mosc) 81(7):709-22.

Shizuya H, Birren B, Kim U J, Mancino V, Slepak T, Tachiiri Y, Simon M (1992). Cloning and stable maintenance of 300-kilobase-pair fragments of human DNA in *Escherichia coli* using an F-factor-based vector. Proc Natl Acad Sci U.S.A. 89(18):8794-8797.

Siegmund V, Santner T, Micura R, Marx A (2012). Screening mutant libraries of T7 RNA polymerase for candidates with increased acceptance of 2'-modified nucleotides. Chem Commun (Camb). 48(79):9870-9872.

Son K N, Liang Z, Lipton H L (2015). Double-stranded RNA Is detected by immunofluorescence analysis in RNA and DNA virus infections, including those by negative-stranded RNA viruses. J Virol. 89(18):9383-9392.

Stepinski J, Waddell C, Stolarski R, Darzynkiewicz E, Rhoads R E (2001). Synthesis and properties of mRNAs containing the novel "anti-reverse" cap analogs 7-methyl (3'-O-methyl)GpppG and 7-methyl (3'-deoxy)GpppG. RNA 7(10):1486-1495.

Studier F W, Moffatt B A (1986). Use of bacteriophage T7 RNA polymerase to direct selective high-level expression of cloned genes. J Mol Biol. 189(1):113-130.

Thieme F, Engler C, Kandzia R, Marillonnet S (2011). Quick and clean cloning: a ligation-independent cloning strategy for selective cloning of specific PCR products from non-specific mixes. PLoS One 6(6): e20556

Tsygankov Y D, Chistoserdov A Y (1985). Specific-purpose broad-host-range vectors. Plasmid 14(2):118-125.

Vroom J A, Wang C L (2008). Modular construction of plasmids through ligation-free assembly of vector components with oligonucleotide linkers. Biotechniques 44(7): 924-926.

Wang R, Xue Y, Wu X, Song X, Peng J (2010). Enhancement of engineered trifunctional enzyme by optimizing linker peptides for degradation of agricultural by-products. Enzyme and Microb. Technol. 47 (5): 194-199.

Weber F, Wagner V, Rasmussen S B, Hartmann R, Paludan S R (2006). Double-stranded RNA is produced by positive-strand RNA viruses and DNA viruses but not in detectable amounts by negative-strand RNA viruses. J Virol. 80(10): 5059-5064.

Wilson C, Keefe A D (2006). Building oligonucleotide therapeutics using non-natural chemistries. Curr Opin Chem Biol. 10(6):607-614.

Yanisch-Perron C, Vieira J, Messing J (1985). Improved M13 phage cloning vectors and host strains: nucleotide sequences of the M13mp18 and pUC19 vectors. Gene 33(1):103-119.

Zangger H, Ronet C, Desponds C, Kuhlmann F M, Robinson J, Hartley M A, Prevel F, Castiglioni P, Pratlong F, Bastien P, Müller N, Parmentier L, Saravia N G, Beverley S M, Fasel N (2013). Detection of Leishmania RNA virus in Leishmania parasites. PLoS Negl Trop Dis. 7(1):e2006.

Zhu B, Cai G, Hall E O, Freeman G J (2007). In-fusion assembly: seamless engineering of multidomain fusion proteins, modular vectors, and mutations. BioTechniques 43:354-359.

Zhu B, Tabor S, Raytcheva D A, Hernandez A, King J A, Richardson C C (2013). The RNA polymerase of marine cyanophage SynS. J Biol Chem. 288(5):3545-3552.

Zhu B, Tabor S, Richardson C C (2014). SynS RNA polymerase synthesizes precise run-off RNA products. Nucleic Acids Res. 42(5):e33.

SEQUENCE LISTING (187 sequences)

SEQ ID NO: 1 - protein, 810 aa, Yersinia phage phiR8-01
MITLEQQLAWEHKHRELGRDKVMESLRKAEEQGRVTDTPLGTGVLRKYIMWLSQRIATDLTVDLGKPGRSKAHSPLLKDLDPDSVALITISSVINTLSQDNRGLSAVAMQIGKTIYGELALCYFRDMKEDLYEAMVHDLTKKMSKDLRHRLTVMRMQAEKAGVSIPEWTPSQKLQVGLYLLSLIDGEDGLVEQYTDFTNKKTTYKLQLRPAVMQLMNSAESSILAHAGFAAPCLIQPQDWDGDGVGGFYGDLKIRAPRFFKGDSYQMEVMKKLGCDLRVVLGMLNAHQSVAWKVNPFILDLVKGMRLRGYETDDVMFTSAHPEPPRPLFLDLADKIGMTVPQEVEFKQWKQTKRDWHTKIRLVSRAEAKLSRVIYAAQDMLEYSEFFFVFQTDDRGRMYPVSGPLNPQGSDMQKAMLHAAHGEPIADKVAEKWFKLNLATKYGVDKLNIDQCVQWTIDNHDNIMRAAEDPLNRDAFYWWSEADKPLQFIALCDEYRRYHLDPVNFVARIAVAMDGTCNGLQNYSALLRDEVGGRATNLIGEDGDAPNDIYGDVAVAAEKRLQYAEECAAKLAWLKEGFNRGLTKKSVMTQVYGSTFGTCRKSIVAYCVEKALFEDKERWEFADFASHLVWEGIGDVVVKGKEAMDWLRKVSGCAMKTGDDYISWPAPSGFRVVQVYRKSEVKRVQAQVGNKITLRLREETDLPDKIRHRNATPPNFIHSVDASHMAFVSVRMYLMFPGLFMHMIHDDFGALPSKAQALYDTIRSEFVQMHENYSLDCFVSEYGHRVKLPPVPERGSLDIRCVLTSPNFFR

SEQ ID NO: 2 - protein, 816 aa, Aeromonas phage phiAS7
MATLQDQLAWETYQRDLGRTKLEQQLRKAEEKGRIADTPLGSSVLRRYVLWMSERLAKDITEDLGKAGRSKAYSPLLHALDPDAVSLLAITTLVESVCSRKEGYIHLGFLASEIGRRVYGELALASFRDINPELYEALTKDLQSKMSQDLRHKLTVFRMQAQKAGIELPEWTPSQKAQVGSYLVSLMEKQSGDPKYLCELDTVATGHKSAYVVYLSKHVHELMAEIEDRMMLKAGFAAPCLIPPQPWDADGTQGGFYGDLKVRAVRFFKGSSEQWEIMRSEGHDPAIVLGMLNAVQNVAWKVNPFILDLIKQMRAKGLETKTVRTTAALPKPERPLFLDLQDGALTPEQEEEKKRWKRKMRDWHTEVRKVSRIEARLAVAIAAAEEMLKHDRFYFTHQVCDRFRMYPVSGPLSPQGADNQKALLHSADGGPIDSDEALYWFKLNIAAKFGIDKLSPEDCVKWVDDNETNIIRAASDPAGRDAFHWWSQADKPLQFIAVCDEYRRYKLDPSGFVARIACAMDGTCNGLQNYSALLRDEVGGRATNLISAEDRVPADIYGDVARASWVRLLESVECPFRTAWMAHGFNRKLTKPSVMTQVYGSTYGTCRKSILSYCIENELFEDEEYEHADFAGKLVWAGIDDVVVKAKEAMKWLRESAGAVMREGANYITWLAPSGARVVQIYNKYDELRVWTHVGNKIRLQLRGPEHPDKPDKMRHRNAFPPNFIHSVDASHMAMVAVRMVKEFGLGVFLHLIHDDFGALPHQAGTLARVIREEFIAMHEGYSLERIREQYPFLAPVPQRGNLDINCVLDSVNFFR

SEQ ID NO: 3 - protein, 804 aa, Aquamicrobium phage P14
MLTQEEIEREAYQHGRNRSAKTISRNEEEGRANANPYAQAIYRRFVLPLADMIKKDVSEKRTGRRQAHVQLLAPIDPLAVAFIAVRGVLNALLTDSDAGGRKVGHTVGASVYHEYCLSVFHEAEPDLFFAITNDLGRRMSKSERHRMTVYKMSAKANGVQFNEWGQGNVDQVGGYLIDCLEQLGMVYTSTGTMKRGRGFQHVINVELSSEVLTIVSRISDRFIETTPYFLPCVEKPKPWVSLDDGGFHTKEMRRLHPFMIRCRPGQRDHFRQADLSKEMECINALQETAWRVNKRLLDTVKKVSHHFDMDEILSMEDFPPPERPGFLDGMKEADMSADQLSQFKAWKRDMASWHTEMKLRGTRYGRFSTAVRVANQFVDYDELYFVYFADFRGRKYVQTTGISPQGSDLQKALLEFAKGEPLDTPEAVNWFKILGANKWGYDKASLMDRVAWVDSHHDQIIQFAQDPIGNYGWKDADSPLQFLAWCFEYEQWTKFPKYFLSRLPVSMDGTCNGLQNFSAMLRDELGGKATNLVPSDECQDIYAMVAEETTRLLVQEAPDENGYRDKWLAHGINRTLVKRSVMTLPYGSTRFSCADFINGDYLKAGLAPEFSRQEYSKAANYLSHIVWEAISTVVVKAREAMDWLQAAARQIIAEGHETISWVSPSGFPALQTYWEQEVHRVRSRLCGGAKLVLMSDTDKPSVRKHSNGIAPNFIHSMDAAHLTLTTVQSSTEGIHSLAMIHDDYGTHARYAGRLYSIIREVFVNIYESCDPLEELRSRYPFLPPVPDRGNLDINLVRESVYFFS

SEQ ID NO: 4 - protein, 805 aa, Caulobacter phage Percy
MLTQVELEAEMYAHGRHRAERMMSRNEDAGSANNNPYAPAIYRRFVLPLAELIREDVEHKRPGRRKAHATLLEPMNSEAVAYLAVRNVLNLMLMNANEDIRARNVATAVGKSVYHELMLSLFSEAEPDLFYTLVNDLGRRMSKSERHRMTVFKMQAKEAGVPFPEWGVAGVEQVGAYLLDQLEQLGMVTTWMTVIPGIGRAKPKKVYDIRLTPELVELIGAIKGNIIECTPYFLPCVEPPKPWTSVNSGGFHTKDMRRMQPFAVRSYGGWSEYAEHDMTMPLAAINALQSTAWKINTTMLETIRDVARHFDMDEILSQAEYPSPPRPEWLDGDMKFDQMTKDQQDEFVRWKREKSEWFTQMKLRGTKYGRFYAATTVAEKFASYPAIYFVYFADFRGRLYAQTTGVSPQGSDMQKSLIHFASGKPLATLEAERWFCIHGANKWGYDKASLDDRVKWVKDRHDLIMAFAENPVDNQGWTEADCPLQFLAWAMEYRDWQTAPHTFLSRIPVGLDGSCNGLQNFSAMLRDEVGGRATNLVPSALPNDIYQMVADVTALKLRQVEPDERGFRDKWLKHGMNRSLVKRSVMTLPYGSTRFSCADFIVGDYLKAGKATEFEKQEYQAAAQYLSHFVWDAIGEVVVKAREAMSWLQSSTKAILAEHGRITWTAPSGFPVFQMYVEQDMHRINTHLNGNAKIKVTVDNDKPDKSRHKNGVAPNFIHSYDAAHMTETAVYGSGEGMCLAMIHDDYGTHAADTERLFHLIRETFVSIYERCDPLVEFAAAYNLPDPPSRGSLDLRLVLESPYFFS

SEQ ID NO: 5 - protein, 836 aa, Xanthomonas phage f30-Xaj
MLSQVELEMETYAFGKERMEKSIARNEEQGGAGNNPYAQAVYRRFVLPLAERIRADIDSPRIGRAQAHVPLLRAKYDPERQNKRGQAVSAEEQAREWYEAVAFVAVRGALTSCMRDKHGEGSDRDVLKNVGINVYHEYLLTQFADAEPTLFYHLMNDMDRKLSVNENHRMTVMKMQGRKNGIEFVEWGQAQRDQVGAYLCDQLAQLGMLEIGVVTETAASAGAAYRKFQTKTHVKIVLTNEVRKLITQISDFVIEATPFYLPCVAPPMDWVDIDNGGFHTKEMRRLNPWMVKTYAQTRDEYRAAELRNEMAAINALQRVPWRINKRLMEAVSAIAKVHDMEEIISQGELPKPRKPEWLTKDMTKETMSHNQELEFKQWKRDMSNWHTDERLRQNKGNRFYNAMKVARKFAEYPSIYFVYFADFRGRKYVQTTGVSPQGSDLQKALLEFADGKPLLTKDAKDWFCITGANRWGYDKASLPNRVKWVAEHHDQIMAFAADPVHNDEWKTADKPLQFLSWCMEYEQWQVSGDRFLSRIAVGMDGSCNGLQNFSAMLRDAAGGVATNLIPAPLPNDIYQMVADRVTAILLGEDDDAEGYRTLWLGHGLTRSLVKRSVMTLPYGSRQSSWADFIIEDYLKCGKFPSLDKALYGPAARFLSKRMGEAIADTVVAAAGAMEWLQRGSGSILNQGYDRIRWITPSGFPVVQVYWESEEHRINTKLCGNAKLSLRKSTDAVKKSRHRNGIAPNFVHSLDASHLTLVVNAAKAEGIDAFAMIHDDFGTHAADSAALYRIIREVFVSMYERHDVLSAFHSAYPFLPEPPPMGELDLRQVLDSPYFFS

SEQ ID NO: 6 - protein, 831 aa, Burkholderia phage Bp-AMP4
MTQAYEFVGPFESPQRALEREISREGRERALRRMEENEQHGRAEMNPYARPIYRRYLLPLIDAIRESVAGTGKAGRRKAHVALLKPLDPAAVAFIAVRTALVSLLNKSDSDDARVIGRFIGVAVYNELVFSLFENANPELYWEIVKDIERRNSTDARYKYRIIRDSANKRDMELPDWSPADREQVGLFLIEQLRLLGMVEVEREHINLSGGRIREKFTIDFTDDALGIIGNVKNMVELTTPLHLPFIEPPKPWTAFNRGGYHTDAMRRLSPYCISAPRVKKREVLDIYRNADLTKVRAAINKLQSVRWQINSDMLDTVREIARYTETEEVLKQADIDPPARPEWLPLDKDALKFEDMTEQQQEAFKAWKRRMRDWHNAKRSRGTKFKRFYSATSVADRFKGYDAIYFMYQADFRGRLYAVTTGVSPQGSDLQKCLLRFADGKPLADADAVRWFKVNGANRFGVDKVPFDDRVRWVDDNDEGIVACADDPVSHDWWRDADSPLQFLAWAKEYAAWRRDPANFVSRIPVGMDGSCNGLQHFSAMLRDEVGGRATNLLPGAKPNDIYQQVADVVTRKLAGLKLDQLPERDQGYAAKWISHGMNRKLVKRSVMTLPYGSTRFSCAQFIVDDYLKAGVAPQFEQSEYRHAANFLSHLVWDSIGQVVVAASAAMSWLQKCASTLIRRGASQIRWSAPSGFPVVQVYNKSDVIAVNSLLLGGVRIKVGSMTEDPDVNHHKNGMAPNFVHSMDAAHLTLTVNECDRVGIDSLAMIHDDYGTHAADAQRLFEVIRDTFVRMYEQNNPLAWFRDHYDGLPEIPKAGSLDIEQVRHSPYFFA

SEQ ID NO: 7 - protein, 803 aa, Pseudomonas phage Bf7
MNQADLEREMADGGRRAAMARFQTAEAANDAASNPYAAAIFRRFIKPLSEGLDVYLHKAVRGVAAKSKVLLRGQDTLALAYITIRGVINASLSEGEAVFAGVAMDIGRTVYSEVALRQFEDLNPELYYTLVQDLERRMTKSERHRFNVMRSSAEKDGTPLPIWEPALKMDVGTLLLGASLDIGLIETFDLRLKGKTTKHLRLHPDLLALVEQIKGFVAGASPFNLPCVEPPKPWVTPTDGGWHTMAMRRTLPCMVRGQATATVEDVGPRVLKALNKVQSVAWEVNERILEVAEFAREHFDVQDVLVSDKRGGMPDKPLFMQADPVLKIVDMNEFELAQFTEWRQEAREWHTQQKVRGAHAGSTNEAIRVANKYKGKPLWFVYSVDYRSRFYASGQGLSPQGNDLSKALIHFARSAPIRTSAGLFWFRVAGANKWAVNKLDKQPLDVRAQWVIDNADFICRIADDPISHREWTDADVPFQFLAWCFEYAAWVRNPESFRTRIPLGQDGSCNGLQHFSAMLRDRVGGRATNLIPDRVQHDIYGLVATATAGIVQSDIDECDIAKRWKSHELSRSLVKRSVMTLPYGSTRHSCRDFIMKEYMDKGSAPEFDKRENEPAARWLSYRVWDGIGKVVVKGRQAMEWLQAASAIMCAGNAPHIEWRNPAGFLVRQRYHAREMLRVSCHSLSGKRIRINVQTFKDEGDPRRHRNGIAPNFVHSCDAAHLTFFTNDWEDEDGGDLALVHDDYGALADEVPKLHRILRRSFVDMYLYHDPLKALAAQVEGLPELPEAGDLNLEDVTRSVYFFC

SEQ ID NO: 8 - protein, 803 aa, Pseudomonas phage Andromeda
MNQAELEREMADGGRRAAMARFETAESANDAASNPYAAAIFRRFIKPLSEGLDVYLHKAVRGVAAKSKVLLRGQDTLALAYITIRGVINASLSEGEAVFAGVAMEIGRTVYSEVALRQFEDLNPELYYTLVQDLERRMTKSERHRFNVMRSSAEKDGTPLPVWEPALKMDVGTLLLGASLDIGLIETFDLRMKGKTTKHLRLHPDLLELIEQIKGFVAGASPFNLPCVEPPKPWVTPMDGGWHTNAMRRTLPCMVRGQASATIEDVGPRVLKALNKVQSVAWEVNERILEVAEFAREHFDVQDVLVSDKRGGMPDKPLFMQADPDLKIVDMNEFELAQFTEWRQEAREWHTQQKVRGAHAGSTNEAIRVANKYKGNPLWFVYSVDYRSRFYASGQGLSPQGNDLSKALIHFAKSAPIRTSAGLFWFRVAGANKWAVDKLDKKPLDVRAQWVIDNEEFISRIADDPISHREWTDADVPFQFLAWCFEYAAWRKDPESFRTRIPLGQDGSCNGLQHFSAMLRDRVGGRATNLIPDTVQHDIYGLVATATAGIVQADIDECDIAKRWKSHELSRSLVKRSVMTLPYGSTRHSCRDFIMKEYMDKGSAPEFDKRENEPAARWLSYRVWDGIGEVVVKGRQAMEWLQAASAIMCAGNAPHIEWRNPAGFLVRQRYHAREMLRVSCHSLSGKRIRINVQTFRDEGDPRRHRNGIAPNFVHSCDAAHLTFFTNDWEDEDGGDLALVHDDYGALADEVPKLHRILRRSFVDMYLYHDPLKALAAQVEGLPELPESGDLDLEEVNRSVYFFC

SEQ ID NO: 9 - protein, 779 aa, Cyanophage Syn5
MSFDLIARQLQRETEAAELARKRLQDARREANERSYASSNIESRKAIATFLDPIAQRIGERLFTLRRGTGAVDAAEVYKHLKNADHHHLALITMKTALDVLGKDPEPQIQQLTTAIGRNIQLELRLTYYAEENPELYKQASRFFHAGTGTRQKATVIKLKFNREGIEWDQWSRVTCHKVGQWLMLAMADVTGWIERATDRTSGGRKTKTRICYSREFLQHRDTILAAAEQLAFCQWPMLCPPIEWSNDHNGGYLSEQIRRVNPLIRKTGPLGTRKQGDIPLAMLNNLQGQAYKVNPEVLDIANHCYESNVTVGKFIRHAPLPVPPSPGEDCTEDQLTAYKRARREAEDFNAQISQKNWRTTEVMYVARKYADEASFWMPASFDYRGRVYFLNTALNPQGTDFDKALLYFAEEGPVNEWWLSFHVATTYGLDKETMVNRVQWARDNHELIDRIASDPVRHTEWHDADEPWCFLAACLEYKACVIDGTKQTSGLPIGIDATCSGLQHLAAMTRCGRTAALVNVTPTDKPADAYKTVAQASLKHLPKEQHEWITRKVTKRPVMCTPYGVTMSSARGYIRDQLVKDGHKEDLRSPGVLNGIVKAIFNEAIPEVIPGPVQVMAWLKRSAGQIIDRGDSTITWTTPSGFEVVQDLKKSKTYEVKTRIMGGARIKLQVGDGFTDEPDRDHHKSALAPNVVHSNDASLLHLTFAFWDKPFTVIHDCVLGRSCDMDQMGSDIRLHFAEMYKADVMQDWADQVGVELPVDLIKNTLDIDSVNQSLYFFS

SEQ ID NO: 10 - protein, 810 aa, Pantoea phage LIMEzero
MTDLIAKQISMEEEARRRHRQGWLDNINEAMSSGRAGSVPLLHRMMIEAFPKVEEAMQSVFQDSTRGYGAQYRSLLRELGVKECASLALSMAVSGAAAEQTVIATLKGMGQAVVAEVVYKRAAAAGEVQAAYMDRVKVDNRKAKSKDPQHIIAKVRKSAQNVGEDPMMLPQRAFITIGKLMMKCVAGTGLVETDRRGGNARMGGMAHFVLHEDVLSTLNDWMDLPRADGGCYPPMLVPPVQIAEDGRSGMWQSPGQRDQYRVISRMNRREYRALKIDPTPVIEPCMALSSVPYRINPLVLELLQRSRTDVMGLPVMPVEPKLPFQIPAGVTFAQYISKFPEPMQQQMDAEAHEFKVRTRIYHTNMRKFMSQMMALNAAVAEAQRYAEFDKVYLPTYADTRGRIYYSSTLNPQGIDGVRALLELAEPVALGDDGLYWLKVHIANSFGYDATDFDDRAKWTDKALPRLREACRIPEAYDSFWSEADSPITAWAAAVELLRAIDSGNPATYMCRVVTQWDATCSGLQHLSAMLRDSVGGAAVNLLDSPGRKADIYLKVADSALEGLRRSELVSSSPLGQWLLRVGVPRAWAKKPVMTYVYGATKHGMIDYYCLMLRESKTPLPEGFRLMQCATFIANLMWDAIPRVVPAAARLMAWLQEIANTTGKEGEYVTFTAPSGLRVPNQYQMYRETSMRLNLLGVHAIQLREAQDRPDPRKCEAAFAPNFVHAMDASHMMRVLHQLWNNGIYMVSIHDSFGCAAAHAGTLHRIIREEFVRMYQQYNPIAELAREYNRTCPEPGDLDISNVLKSSKFFC

SEQ ID NO: 11 - protein, 823 aa, Acinetobacter phage Petty
MQDLYERQLALEEEYSNASLAAGQQVVLDAFKQGRAADISAGRVLLAKAFEAGLEQFTVALAKPSRGLAGKYRKLLHYAPPDVLVMAGLREVINACASAEPVSMQYVLTRVGRIIEAESMLACMQQVNAQYTNRTVQYLDSAGTKSITHRYRTFLSGAQNMGMDWEIWSNTERVQVARILLTELYEATGLFKWVTPQYNSSHTQYYLEPSEALAKHFQDIQSAARAVIKYPPMLIKPMDWEGYMNGGYLTEWFRHNSPMCSLRYVRQIDRNWIVKGLSDEAAQPVRDAMNKAQSTAYRVNKQVLEVLRKATAMRVGILGLPSFAELPQPEFPLADGWQKDDATESELEIFQLWKSRMAAWYTAENKRKGRHTGILIKLRELTRYKDEEALYFPTFIDWRGRLYFRSALNPQANDAVKGCLEFANGKPLGKDGLFWLKVHVANCCGYDKHDPELKAKWTDENWTQIEDFINNPLDVDAPEPDTAFTLLQAGLALQAALSLENPEAYVCHVPVAMDATCSGLQHLSALTRDPVGAYYTNLIDNGTDKKSDIYLRVASVADETKADFCLRKKTIKGKVENVADLVLEHYWKERSISRNMAKKPVMTFVYGSTLLSTIESIALDMSEGGMPVIEEDGKVIYSHTALATPIGKALRRGVLETVPEAAKMMSYLQKIVRSHKDQCMRWFTPVGVPVVNWTEGTTDKRINIRSMGVEKVLMIFRTGEYDTRRAANGIVPNFVHSMDSAHLCATINHFEGDVLPIHDSFATHPSDVSALHTSLRSTFVELYQNFKIEDFLEFNSVDYEEHTPPPQGNLDLSHVINSRYMFG

SEQ ID NO: 12 - protein, 818 aa, Pantoea phage LIMElight
MQTAENSMNITESKVERQLEIENKARTRAIDRSRKAVKDALDSGRASELLPVSRLISAAFSTVSDEIDKIKAEKAPGVGGKYRKFLKLVSTDVLATGSMVYVLDSLCHESQAKSSAQALMAGLGRFVQAEVLNRNLEIAAPAYINRVHEYMKEKHTRSQSHIMRTLRASADAVKLEHDPWSNTECIAVGRLLMQAVWETGLFKWHSHSNQMNYLLPGDQLEKVLTDVVTHSSMMMIAPPMIVPPQDHTTIHDGGYMTDIDRRGTYKNRHITNKQRRDVAKQFASDEAQPLRAAMNKAQNVPYRVNRSVLGWVQAARAQGIGIGMPSTKGRPKPEWRLDGIPKEQYDARELEDFEEWKAVTRQWYTEERKRVSQLRGMAMTIDMCEEYKDEQVLYFPTCVDWRYRLYFKSALNPQGSDLQKALLEFGTGRPLGDRGLHWLKVNVATTFGYDKPLFEERAAWVDLHYAEIERVADAPFETDSFKNADSPWCFLAACIELVNAVRSGCPAEYVSHAPVAMDATNSGGQHFSAMLRDEIGGRLTNLFWNGNTEKADLYMNVKERTDSKVIVAQRNADTVVQATYWRENEITRSMTKRPAMTFFYSATVRSCSDYIMLGALDEGYQPLQDFSMMKLSGFLAPLMRESIEEAMPAAAKAMKFAQQVCRTIPLENHLQWNTPLGGLIINRYTTTEEKRVNIRSMGLTQVVAYNRNYDLNNRRKAASGIAPNFVHGQDSTHLMMVILRHSGYIVPIHDSVATHACDVDEMHKHLREAFCDLYTSTDPLQTLKEAAEAAGGDCSEIDMPEHGTLNLELVKDSPFFFC

SEQ ID NO: 13 - protein, 885 aa, Erwinia amylovora phage Era103
MNADLMQAQIELENNYFNGGIARFEASQARHENNGESSQTAWNRRLISEFVAPMAEALQVHKEFYSKKKGKPSKSLAYLQCVGNEVASYITMKVALDMLASGVSYTAIAMTIATRIEDQARFTKLEGAAEKYVAKVLDNLKRNSSKQYQHGHNVMVAAERKLSEGRPGQEPSVTRWIAWPQDDLLAIGMTLLQIMEKSVFFEGEPVFFRYNKNDNGGGKVKLIPVLGVADNVNAWIEAFKEHVSVMSPAYGPCVVPPRDWKTPFNGGFHTEAVASRVRFVKGRTDHVRKLTQKQMPKVYKAINFLQSVKWSINTDTLETAQEILAKNLGLGMPSFAPIITRDNKPACPLPLEFQHLRGEELRQSLTPTQWDSFLAWKGDCSKLYTMETKRTSKASAVARMLNQASDLAKFESIYFVYAMDSRGRVYVQSSGVSPQSDDLGKSLLRSTKGKTLDSSEALHWFLVLGGNLWGWDKKPFDVRVSHVLDEDFADMVRDVATDPLTFRNWLSADEPWQFLAWAKEYARYLDAVDDGTSAEFVTYLPVHQDGSCSGIQHYSAMLRDKTGAKAVNLMPSDTPQDIYGEVAKVVIRKNKAIADMADSEQEGYSIGKMKLSVAVSKAMAESWDAIGITRSLTKKPVMTLPYGSTRITCRESIDDYLVSLEEDELRKAKAEGRERNAVHPFESEELEGLSYKNALNYMTSLVWPSISEVVRAPVVAMKAIRQLARAVTKLNEGLYWTTPTGFIVEQRIYATDNLRVSSYLMGRVRMSLTVETETIDEAAMMGAAAPNFVHSLDAAHLISAVCAMADAGLEFVAVIHDSFGTLACDTQVLRDSLRSEMVAQYADVNRLEMLVQENEGRLLQDFGISLPEMGDFDLTEILKSDYCFA

SEQ ID NO: 14 - protein, 875 aa, Proteus phage vB_PmiP_Pm5460
MDLQEIQLQLENEMFNGGIRRFEADQQRHLQAGNASDTAWNRKLISEFIAPMAQGIQAYKEEYKGKIGRAPRALAFLNCVENEVSAYITMKVVMDMIQTDVTLQSIAMSIADRIEDQVRFSNLEGKAKKYFEKVKASLKASRSKQYAHGHKVMVVAEKNLAEKSEDIDRWIPWGKEELLNIGLTLLEILENSVFFNGEPVFFRTIRTMGYKKTLYFLQTSENIGEWVRAFKDHVAQLSPAYAPCVVPPRPWKSPFNGGFHTEKVASRIRLVKGDREHVRKLTQKQMPKVYKAINALQNTQWQVNKDILNVADEVVRLDLGYGVPHFKPLIDKDNKPANPVPVEFQHLRGRELKEVLSDEQWQAFIHWKGECAKLYTAETKRGSKSASVVRMLGQARKYSMFDAIYFVYAMDSRSRVYAQSSTLSPQSDDLGKSLLRFTEGRSINSVEDLKWFCINGANLWGWDKKTFDVRLNNVLQEDFQEMCRDIASDPLTFTQWVGADAPYQFLAWAFEYANYLDLVDEGRAHEFKTHLPVHQDGSCSGIQHYSAMLKDEVGARAVNLKPSDAPQDIYGEVAKVVIRKNNENMEASEEDFMTSGSMHLQGAVLRAMASSWDSVGITRGLTKKPVMTLPYGSTRITCRESVEDYLITLEEEEVKRAIAENRKANKVHPFVSDKEEGQILERDALNYMTALIWPSISEVVKAPIVAMRMIKQLARYASKRNEGLEYTLPTGFILKQKIMATEMLRVRTMLMGDIRMSLQVDTDVVDETAMSGASAPNFVHGHDASHLILTVCDLVDKGIKSIAVIHDSFGTHADNTVALRDSLRHKMVEMYENTNVLQKLLEEHEERWLVDTGIKVPEQGTFDIREILNSDYVFA

SEQ ID NO: 15 - protein, 875 aa, Proteus phage PM 93
MDLQEIQLQLENEMFNGGIRRFEADQQRHLQAGNASDTAWNRKLISEFIAPMAQGIQAYKEEYKGKIGRAPRALAFLNCVENEVSAYITMKVVMDMIQTDVTLQSIAMSIADRIEDQVRFSNLEGKAKKYFEKVKASLKASRSKQYAHGHKVMVVAEKNLAEKSEDIDRWIPWGKEELLNIGLTLLEILENSVFFNGEPVFFRTIRTMGYKKTLYFLQTSENIGEWVRAFKDHVAQLSPAYAPCVVPPRPWKSPFNGGFHTEKVASRIRLVKGDREHVRKLTQKQMPKVYKAINALQNTKWQVNKEILNVADEVVRLDLGYGVPHFKPLIDKDNKPANPVPVEFQHLRGRELKEVLSDEQWQSFIHWKGECAKLYTAETKRGSKSASVVRMLGQARKYSMFDAIYFVYAMDSRSRVYAQSSTLSPQSDDLGKALLRFTEGRSINSVEDLKWFCINGANLWGWDKKTFDVRLNNVLQEDFQEMCRDIASDPLTFTQWVGADAPYQFLAWAFEYANYLDLVDEGRAHEFKTHLPVHQDGSCSGIQHYSAMLKDEVGARAVNLKPSDAPQDIYGEVAKVVIRKNNENMEASEEDFMTSGSMHLQGAVLRAMASSWDSVGITRGLTKKPVMTLPYGSTRITCRESVEDYLITLEEEEVKRAIAENRKANKVHPFVSDKEEGQILERDALNYMTALIWPSISEVVKAPIVAMRMIKQLARYASKRNEGLEYTLPTGFILKQKIMATEMLRVRTMLMGDIRMSLQVDTDVVDETAMSGASAPNFVHGHDASHLILTVCDLVDKGIKSIAVIHDSFGTHADNTVALRDSLRHKMVEMYENTNALQKLLEEHEERWLVDTGIKVPEQGTFDIREILNSDYVFA

SEQ ID NO: 16 - protein, 874 aa, Salmonella virus SP6
MQDLHAIQLQLEEEMFNGGIRRFEADQQRQIAAGSESDTAWNRRLLSELIAPMAEGIQAYKEEYEGKKGRAPRALAFLQCVENEVAAYITMKVVMDMLNTDATLQAIAMSVAERIEDQVRFSKLEGHAAKYFEKVKKSLKASRTKSYRHAHNVAVVAEKSVAEKDADFDRWEAWPKETQLQIGTTLLEILEGSVFYNGEPVFMRAMRTYGGKTIYYLQTSESVGQWISAFKEHVAQLSPAYAPCVIPPRPWRTPFNGGFHTEKVASRIRLVKGNREHVRKLTQKQMPKVYKAINALQNTQWQINKDVLAVIEEVIRLDLGYGVPSFKPLIDKENKPANPVPVEFQHLRGRELKEMLSPEQWQQFINWKGECARLYTAETKRGSKSAAVVRMVGQARKYSAFESIYFVYAMDSRSRVYVQSSTLSPQSNDLGKALLRFTEGRPVNGVEALKWFCINGANLWGWDKKTFDVRVSNVLDEEFQDMCRDIAADPLTFTQWAKADAPYEFLAWCFEYAQYLDLVDEGRADEFRTHLPVHQDGSCSGIQHYSAMLRDEVGAKAVNLKPSDAPQDIYGAVAQVVIKKNALYMDADDATTFTSGSVTLSGTELRAMASAWDSIGITRSLTKKPVMTLPYGSTRLTCRESVIDYIVDLEEKEAQKAVAEGRTANKVHPFEDDRQDYLTPGAAYNYMTALIWPSISEVVKAPIVAMKMIRQLARFAAKRNEGLMYTLPTGFILEQKIMATEMLRVRTCLMGDIKMSLQVETDIVDEAAMMGAAAPNFVHGHDASHLILTVCELVDKGVTSIAVIHDSFGTHADNTLTLRVALKGQMVAMYIDGNALQKLLEEHEERWMVDTGIEVPEQGEFDLNEIMDSEYVFA

SEQ ID NO: 17 - protein, 875 aa, Lelliottia phage phD2B
MQDLHAIQLQFEEEMFNGGIRRFEADNQRVIASGNESETAWNRRLLSELIAPMAEGINAYKESYVGKRGKPALALAFLQCVENEVAAYITMKVVMDMLNTDVTLQAVAMTIAERIEDQVRFSKLDAHANKYFEKVKASLKASKSKQYRHGHRVMVAAEKSVSEKDADFDRWEAWPKETCLQIGATLLDILESSVFYQGEPVFFRAIRQNGVRSTYYLQTSETVGAWIEEFKEHVAQLAPAYAPCVVPPRDWKSPFNGGFHTEKVSSRVRLVKGAREHVRKLTVKQMPNVYKAINALQRTEWQVNTDVMKVADDVIRLNLGYGMPSFKPLIDKENKPLNPVPVEFQHLRGRELKEMLTAEQWDTFIAWKGECSRLYTAETKRGSKSAAVVRMVGQARKYSAFNAIHFVYAMDSRSRVYAQSSTLSPQSNDLGKALLRFTEKRALNGSQALKWFCVAGANLWGWDKKTFGVRVSNVLDGEFQDMCRDIAADPLTFTQWAGADEPYQFLAWAMEYANYLDLLDEDRQEEFRTQLPVHQDGSCSGIQHYSAMLKDSVGAAAVNLLPSDEPQDIYGRVAQVVIGKVAQHANALDADTFTSGKLTLTGDALRTMAASWDAIGITRGLTKKPVMTLPYGSTRITCREAVADYLIDLEEKEAQKAVAEGRGVNLVHPFGQAEGQMTEAMALNYMTALIWPSISEVVKAPIVAMKMIRALARFAAKRNEGLEYTLPTGFILQQKIMATDLLRVRTVLSGDIKMALRLQVDTDIVDESAMMGAAAPNFVHGHDASHLILSVCAMVDEGITSIAVIHDSFGTHADHTPDLRNALKGQMVEMYANTNALQKLLSEHEDRWMVDTKIEVPEQGDFDVNLIMESEYCFA

SEQ ID NO: 18 - protein, 877 aa, Escherichia phage ECBP5
MYTSDELYQKQLELEGEMHGYGVTRFDRNNQRAIDSGTPSDTDWNRRLLSNFIEPMVKGINAYKEYYKTKAGRPTVALKYIRQVQPEQAAYIAIKNILDVLGSTTFDANWLVTTIGRRIEDQVRFTKLEEAAPKYVGKVKDSLAKRNSLQYAHQHKVLVATEKKLAENPDRAQLELPRWQEWAEEDCKHVGSLLVNIFEQCILFEGEPVIRKEVQTVRKGTLVFIKPTEKVTKWIHEFREAIGGLAPAYAPCVVPPLDWTSPFTGGFHTEAVSSTLHLAKVRNKRHLRKLTKEQMPAVYKAVNNLQKVRWRISERVLATANTLVELGLPYALPSKDESDWKEKNPCPVPEYLQDLRGEQLKAALTASQWEAFQEWKQLARQNYDEESERVASFREVVRTLGQANRYVGFDAIYFVYTLDFRGRVYCQSSLVSPQGGDLQKALIKFADGMKLGERGEYWFKVHGANEWGWDKKTFDERVALVSEPEFCEMCLDIASDPVTFNDWIKADKPWQFLNWCFEYADFLKHVQSAGNPQDFVSYIPCAMDGSCSGIQHYSAMLRDTVGGTAVNLVNSDKPNDIYGEVCKVTIKELQAIADGSQVYDSKIDPVLAQQLAQEWLRLQPNRSLTKKPVMTLPYGSTQLTCREHVSQWLKDLQKEENKRAKAEFREPMKVHAFGDADSAMPLKFAESLMTSIVWHSIGKVVVAARAGMAYIKAVTSSVAKMNMPLEWTTPTGFIVRQEIYQFTTRQVNTQLLGGTKFVVSTKSKDIDYHRMINSCAPNFVHSMDASHLTLATNYFADAGISSIAVIHDSFGTHAGATDLLRERLRASMVDMYEQHDVITNFLAETEGRLMTAFEHIRVPERGELQLDSINQSTYAFA

SEQ ID NO: 19 - protein, 859 aa, Delftia phage IME-DE1
MEYNPLTELASLYGEDLAAEQLRLEAEAYSLGEKRFMEAMEFKAETGQAGDTRVARPLVAELLPKLSMKIIEFIAFQRNGKPGKKAAAFKYIQGIDPDRISYLAIRTALNLSVASELPVVQLCEAIGRDVEDEARFGRIREQDEKAFKQRIAPEILKRSADHFKRAYARAVEVSMKDAGDLGAWESWGSSNRVAVGFKMVELMIEIGILVLSDINPGNPKMHKKVITLSDEVSRWLSERAQFLAGCNPMWSPSVVPPKPWTGIHRGAYWGRGKSNPKFIRGLGKQARKRYYDVDLSNVMNAVNLIQSTPWKVNAKVLEVAREVSQWKHISIDGIASPEVVAKPVRLEGMDDDEKVLKTWKREAAKTWRKERARRSRRMAMELVLEQANRFVKYDRIWFPHNVDFRSRVYSIPSALSPQGNDLSKGLLMLADATPMGKDGEYWLRMHIANVAGLDKEPMDVRQKWTYDHEDLILETAENPLENLWWATEADSPFCFLAACLEYRNWKASHNPEAYVCGLPIAFDGSCSGIQHFSAMLRDEVGGAAVNLTPGERPSDIYRIVSDKVQEVINHDLIHGSDNVMTEQVCDETGDILERIQYGSKAVAKWWNDYGITRKVTKRSVMTLPYGSKKFGFADQLLEDIIMPAVDSKGEHVFPAPATAARYMADLIWTALETTVVAAVGAMAWLQKAAGALASQGMPATWTTPVGFPVWQEYKVKATKRVDTVICGSIRMTMTVELTEKTEENELDRHKQVSAISPNFVHSMDASHLMMTVLAAAEQGVQHFVMIHDSFGTCPGNAGAMFRVVRETMVKTYTENDVILGFYEGFAADLTEKNAEKIPALPPKGELNLEEILESRYCFC

SEQ ID NO: 20 - protein, 882 aa, Pseudomonas phage phi15
MIEVAKNDFSDVKTDWAFRVLSELYGEELAAAQLALEHESHEIGEAKFKKALDRQMKRGETSETSVAKPLVAMLVPKFVEKMDAWVEHQMKNVRRKSVALKFIQMVATERVAVITIKTVINAMSQGDVVLQAIAGRIGRGIEEEARFGRIRDQEAKHFKKYIREALNKRNGHTYKRAYMHAVEDRMLEAGELNGAWSDWDNEDPTIIAHIGLRCIEALIESSGLVRITRRSAGNVKEDCNVLELEPQWVEMLNQRAFTLAGVNTYHQPCVVPPRPWTRPVGGGYWGKGRRPTRFIRVHNKKALERYRDVDMEAVYKAVNIAQNTAWSINKRILEVAEALASWTNVPISKWPKAETQELPVKPHDIETNEEARNAWKKQASGVYRSESSRVSRRMSLETTLETARKFADFEAIYFPHNLDWRGRVYALPVFNPQRDDLTKGLLQASKGEPVGEDGIKWLMIHGANTAGVDKVPFDERQQWVRDNERTILQCAEDPLTHTEWMSMDSPFCFLAFCFEWAGVVKDGPNHVSALPIAFDGSCSGIQHFSAMLRDETGGRAVNLLPSERVQDIYRLVSDGVNAALRDDAVHGTDDSTDVHVDEKTGEITERRVLGTRTLAAAWLAHGVDRSVTKRSVMTLAYGSKEFGFTDQVRDDIITPAVDAGSLNFPQPQQAARYMAHLIWVSVGKTVVAAVEAMEWLQKSAKLLAAIVKEKKGPEKGKILKPAMPVYWVTPDGFPVWQEYRVQQAKRIDMILMGDVRLTATVLHQQDQIDARKQESGISPNFVHSMDGNHLRQTVVHAHDAYDITFFALIHDSFGTIPAKAGQLFKAVRETMVTAYEHNDVLADFREQFIDQLHETQMDKMPELPKKGTLDIREILKSQFAFA

SEQ ID NO: 21 - protein, 883 aa, Vibrio phage VP3
MANVIKPQSHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEYGVTRSVTKRSVMTLAYGSKEYGFADQVFEDTVMPAIDNGKGTMFTEPSQACRFMAKLIWDAVSKTVVAAVEAMQWLQSAAKLVSSEVKDKKSGEILKHAMPVHWTTPNGFPVWSEYCKQEQKVIDCVILGSMRLQLKLNMRDKKEIDTAKQASGIAPNFVHSMDASHLQMTVNKCFKVYGIHSFAMIHDSFGCHAGFASKMFRAVRETMVETYEEHDVIQEFYNQFEKQLHESQIEKMPALPRKGNLELREILKSLYTFS

SEQ ID NO: 22 - protein, 883 aa, Vibriophage VP4
MANVIKPQSHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWTNCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEYGVTRSVTKRSVMTLAYGSKEYGFADQVFEDTVMPAIDNGKGTMFTEPSQACRFMAKLIWDAVSKTVVAAVEAMQWLQSAAKLVSSEVKDKKSGEILKHAMPVHWTTPNGFPVWSEYCKQEQKVIDCVILGSMRLQLKLNMRDKKEIDTAKQASGIAPNFVHSMDASHLQMTVNKCFKVYGIHSFAMIHDSFGCHAGFASKMFRAVRETMVETYEEHDVIQEFYNQFEKQLHESQIEKMPALPRKGNLELREILKSLYTFS

SEQ ID NO: 23 - protein, 883 aa, Vibrio phage ICP3_2008_A
MANVIKPESHNFSDISAAILPFNVLADSYGEALAAEQLMLEHESYQLGEARFIKAMERQVERGEVSDNAVAKPLLDTLIPALAARITEFIEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEHGVTRSVTKRSVMTLAYGSKEYGFADQVFEDTVMPAIDNGKGAMFTEPSQACRFMAKLIWDAVSKTVVAAVEAMQWLQSAAKLVSSEVKDKKSGEILKHAMPVHWTTPNGFPVWSEYCKQEQKRIDCVILGTHRMALTINIRDKKEIDAAKQTSGIAPNFVHSMDASHLQMTVNKCFKVYGIHSFAMIHDSFGCHAGFASKMFRAVRETMVETYEEHDVIQEFYNQFEQQLHESQIEKIPVLPRKGNLELREILKSLYTFS

SEQ ID NO: 24 - protein, 883 aa, Vibrio phage ICP3_2007_A
MTNVIKPESHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYDIVAVKVNEVLRDLVISGTEDEMQTLEDKKTGEITERLVLGTRTLAAQWLEYGVTRSVTKRSVMTLAYGSKEYGFADQVFEDTVMPAIDNGKGAMFTEPSQACRFMAKLIWDAVSKTVVAAVEAMQWLQSAAKLVSSEVKDKKSGEILKHAMPVHWTTPNGFPVWSEYCKQEQKRIDCVILGTHRMALTINIRDKKEIDAAKQTSGIAPNFVHSMDASHLQMTVNKCFKVYGIHSFAMIHDSFGCHAGFASKMFRAVRETMVETYEEHDVIQEFYNQFEQQLHESQIEKMPVLPRKGNLELREILKSLYTFS

SEQ ID NO: 25 - protein, 883 aa, Vibrio phage N4
MANVIKPESHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDSNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANILASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEYGVTRSVTKRSVMTLAYGSKEYGFADQVFEDTVMPAIDNGKGAMFTEPSQACRFMAKLIWDAVSKTVVAAVEAMQWLQSAAKLVSSEVKDKKSGEILKHAMPVHWTTPNGFPVWSEYCKQEQKRIDCVILGTHRMALTINIRDKKEIDAAKQTSGIAPNFVHSMDASHLQMTVNKCFKVYGIHSFAMIHDSFGCHAGFASKMFRAVRETMVETYEEHDVIQEFYNQFEQQLHESQIEKMPVLPRKGNLELREILKSLYTFS

SEQ ID NO: 26 - protein, 893 aa, Cronobacter phage Dev2
MSVISIDKHDFSDVSNAIEPFNVLADHYGQDLAVKQLQLEHEAYTEGERRFIKNLERQTERGELADNQVAKPLMQTLVPTIAKAVREWHEGPDGKSSTSRPSVAFTMLSTDEKAVKDRSLRISSESAAVIILKVILSKLVKPEGIPITPMASAIGRTLEDEIRFGRIREQEQEHFKKTIAESLKKRAGASYKKAYMQAVEASMLEQGQLADAWGTWSPTEAVHVGIKMLELVIQSSQLVELKRYGAGNAAADVEMVHLSDFWVKKMAQRGFSLAGIAPVYQPCVVPPKPWTGVVGGGYWAKGRRPLPLIRLGSKAAVQRYEDVYMPEVYEAVNIIQQTPWKVNKKVLEVVNMVEKLNNTPIADIPQMEPLKPEDYAGETEEELKAWKKSAAGIYRREKARQSRRLSLSFIVSQANKFSQFKAIWFPYNMDWRGRVYAVPMFNPQGNDMQKGLLTLAVGKPIGADGFKWLKVHGANCAGVDKVTFEERIKWVEDNHDNIMAAAKAPMDSIGWWGQLDSPFCFLAFCFEYAGVMHHGLSYSCSLPIAFDGSCSGIQHFSAMLRDHVGGHAVNLTPSGKVQDIYRIVSDRVEEQLKELLVNGSDNEVKTFEDKKTGEITERLVLGTRELARQWLTYGMSRSVTKRSVMTLAYGSKEYGFADQVFEDTVMPAIDSGKGAMFTDPSQASRFMAKMIWDAVSVTVVAAVDAMKWLQGAAKLLAAEVKDKKTKEVLKPCLPVHWVTPDGFPVWQEYRKKDTTRLNLLFLGSFNLQPTVNKGSKKELDKHKQESGISPNFVHSQDGSHLRKTVVHTHRKYGVMSFAVIHDSFGTIPADAEFLFKGVRETMVETYRDNDVLQDFYEQFADQLHESQRDKLPELPKRGKLNIEDILLSDFAFA

SEQ ID NO: 27 - protein, 893 aa, Escherichia phage vB_EcoP_GA2A
MSVISIDKHDFSDVSNAIEPFNLLADHYGQDLAVKQLQLEHEAYTEGERRFIKNLERQTERGELADNQVAKPLMQTLVPKIAQAVKEWHEGPDGKLSTSRPSVAFTMLSTEEKAVKDRSLRISCESAAVIILKVILSKLVKPEGIPITPMASAIGRTLEDEIRFGRIRDKEQEHFKKAIAENLNKRAGASYKKAYMQAVETSMLEQGQLEDAWGTWSPTEAVHVGIKMLEIVIQSTQLVELKRYGAGNAATDVEMVHLSDFWVKKMAQRGFSLAGIAPVYQPCVVPPKPWTGVVGGGYWAKGRRPLPLIRLGSKSAVARYEDVYMPEVYDAVNIIQNTPWKVNKKVLDVVNMVEKLNNTPIDDIPQMEPLKPEDYAGETEEELKAWKKAAAGIYRREKARQSRRLSLSFIVNQANKFSQFKAIWFPYNMDWRGRVYAVPMFNPQGNDMQKGLLTLAVGKPIGADGFKWLKVHGANCAGVDKVTFEERIKWVEDNHDNIMTAAKAPMDSIEWWGKLDSPFCFLAFCFEYAGVMHHGLSYNCSLPIAFDGSCSGIQHFSAMLRDHIGGHAVNLTPSGKVQDIYRIVSDRIEEELKVLLINGTDNEMVTHEDKKTGEITERLKLGTRELARQWLTYGMSRKVTKRSVMTLAYGSKEYGFADQVYEDIVMPAIDSGSGAMFTEPSQASRFMAKMIWEAVSVTVVAAVDAMKWLQGAAKLLAAEVKDKKTGEILKPCLPVHWVTPDGFPVWQEYRKKDTTRLNLMFLGSFNLQPTVNKGSKKELDKHKQESGISPNFVHSQDGSHLRKTVVHTHSKYGVMSFAVIHDSFGTIPADAEFLFKGVRETMVETYRDNDVLQDFYEQFADQLHETQRDKLPELPKRGKLNIEDILSSDFAFA

SEQ ID NO: 28 - protein, 893 aa, Enterobacteria phage EcoDS1
MSVISIDKHDFSDVSNAIEPFNLLADHYGQDLAVKQLQLEHEAYTEGERRFIKNLERQTERGELADNQVAKPLMQTLVPKIAQAVREWHEGPDGKLSTSRPSVAFTMLSTEEKAVKDRSLRISCESASVIILKVILSKLVKPEGIPITPMASAIGRTLEDEIRFGRIRDKEKEHFKKAIADNLNKRAGASYKKAYMQAVETSMLEQGQLEDAWGTWSPTEAVHVGIKMLEIVIQSTQLVELKRYGAGNAAADVEMVHLSDFWVKKMAQRGFSLAGIAPVYQPCVVPPKPWTGVVGGGYWAKGRRPLPLIRLGSKSAVARYEDVYMPEVYDAVNIIQNTPWKVNKKVLEVVNMVEKLNNTPIDDIPQMEPLKPEDYAGETEEELKAWKKAAAGIYRREKARQSRRLSLSFIVNQANKFSQFKAIWFPYNMDWRGRVYAVPMFNPQGNDMQKGLLTLAVGKPIGADGFKWLKVHGANCAGIDKVTFEERIKWVEDNHDNIMATAKAPMDSIEWWGKLDSPFCFLAFCFEYAGVMHHGLSYSCSLPIAFDGSCSGIQHFSAMLRDHIGGHAVNLTPSGKVQDIYRIVSDRIEEELKVLLVNGTDNEMVTHEDKKTGEITERLKLGTRELARQWLTYGMSRKVTKRSVMTLAYGSKEYGFADQVYEDIVMPAIDSGSGAMFTEPSQASRFMAKMIWEAVSVTVVAAVDAMKWLQGAAKLLAAEVKDKKTGEILKPCLPVHWVTPDGFPVWQEYRKKDTTRLNLMFLGSFNLQPTVNKGTKKELDKHKQESGISPNFVHSQDGSHLRKTVVHTHRKYGVMSFAVIHDSFGTIPADAEYLFRGVRETMVETYRDNDVLLDFYEQFEYQLHESQRDKLPELPKKGKLNIEDILSSDFAFA

SEQ ID NO: 29 - protein, 883 aa, Morganella phage vB_MmoP_MP2
MSIAAAANKNDFSEIELAAIPFNTLADHYGADLAREQLQLEHESYVMGEERFRKMLERQEKAEEFGDSSVSKPLIITLLPKVSQRVADWVAEWADGSKMGRKPIAWTLLKDIKPDTVAFITIKVVLNKLAGKDEAFMQPLAYAIGSAIEDEARFGRIRELEMAHFKKHAEEQLNKRKGTMYRKAFMSVVEADMLDKGLLGGESWGTWNKTDVMNVGISMLEKLIESTGLVELLPKRHIEEMDRIVIREEYVQLLASRAQTLAGISPMYQPCVVPPKPWVSITGGGYWANGRKPTALIRTHTRKALYRYEDVYMPEVYKAINYAQETPWRVNRKVLAVVNELTKWKNNPVEDMPSIDPLPLPEKPEDIDTNEEALKAWKREAAATYRKDEQRKSRYLSMSFALEQANKFSNKKAIYFPYNMDWRGRVYALPMFNPQGNDMVKGLLTLAKGKPIGKEGFYWLKIHGANCAGVDRVTFPERIKFIEDNHENIMASAEAPLDNLWWTKQDSPFCFLAFCFEYAMVTKKGLGWVCSLPVALDGSCSGIQHFSAMLRDSIGGRAVNLLPSETVQDIYGIVAQKVNEALKEMVINGTDNYTETVTDKSTGEIIERMKLGEKELARQWLEFGVTRSVTKRSVMTLAYGSKEYGFRDQVLEDTIRPAIDSGKGAMFTNPSQAAGFMAKRIWEAVSVTVVAAVGAMKWLQSSAKLLAAEVKDKKTKEVLRKRCAVHWVTPDGFPVWQEYRKPKQKRVHLMFLGSYYDARMKETSSECPIDAHKQESGISPNFVHSQDGNHLRMTVVYAREKYSVESFALIHDSFGTIPADVPNLFKAVRETMVNMYEENDVLADFYEQFADQLHESQLEKMPALPPKGDLNLQDILKSDFAFA

SEQ ID NO: 30 - protein, 883 aa, Yersinia phage Yepe2
MTNVINAPKNDFSDIANAIQPYNILADHYGAQLAATQLELEHEAHTEGEKRFLKAMERQIKAGEFGDNTVAKPLLSSLAPKFVEAWNTWFTEVEAKRGKRPVAYNLVQKVAPEAAAFITLKVTLACLTKEEFTNLQSVATKIGRSIEDELRFGRIRDEEAKHFKNHVQEALNKRVGIVYKKAFMQAVEGKMLEAGQLHTKWTTWTPEEVIHVGVRMLELLIGSTGLVELHRPFAGNIEKDGEYIQLTEQYVDLLSKRAGALAAIAPMYQPCVVPPKPWTSPVGGGYWAAGRKPLSMVRTGSKKGLERYNDVYMPEVYKAVNIAQNTPWKINKKVLAVVNEIVSWKHCPVADVPAMERGELPVKPVDIDTNEVALKAWKKAASAIYRKEKARVSRRMSMEFMLGQANKFAQFKAIWFPMNMDWRGRVYAVPMFNPQGNDMTKGLLTLAKGKPIGVDGFYWLKIHGANTAGVDKVDFAERIKFIDDNHENIMSVAADPIANTWWTEQDSPFCFLAFCFEYAGVQHHGMNYNCSLPLAFDGSCSGIQHFSAMLRDEVGGRAVNLLPSKEVQDIYRIVAERVNEILNQDVINGTDNEVETLTNKDTGEITEKLKLGTKELAGQWLAYGVTRKVTKRSVMTLAYGSKEYGFRDQVLEDTIQPAIDDGKGLMFTQPNQAAGYMAKLIWNAVTVTVVAAVEAMNWLKSAAKLLAAEVKDKKTKEVLRNRCAVYWVTPDGFPVWQEYRKPVQTRLNLMFLGQIRLQPTVNTNKDSGIDARKQESGIAPNFVHSMDGSHLRMTVVRSYEVYGVESFALIHDSFGTIPADAGNLFKAVRETMVNTYEENDVLADFYDQFADQLHESQLDKMPEMPAKGSLDIQEILKSDFAFA

SEQ ID NO: 31 - protein, 882 aa, Kluyvera phage Kvp1
MNVINAPKNDFSDIANAIQPYNILADHYGAQLAATQLELEHEAHTEGEKRFLKAMERQIKAGEFGDNAVAKPLLSSLAPKFIEAWNTWFTEVEAKRGKRPVAYNLVQKVAPEAAAFITLKVTLACLTKEEFTNLQSVATKIGRSIEDELRFGRIRDEEAKHFKNHVQEALNKRVGIVYKKAFMQAVEGKMLDAGQLQTKWTTWTPEESIHVGVRMLELLIGSTGLVELHRPFAGNVEKDGEYIQLTEQYVDLLSKRAGALAAIAPMYQPCVVPPKPWTSPVGGGYWAAGRKPLSLVRTGSKKGLERYNDVYMPEVYKAVNIAQNTPWKINKKVLAVVNEIVNWKHCPVEDVPALERGELPVKPEDIDTNEAALKAWKKAASAIYRKEKARVSRRMSMEFMLGQANKFAQFKAIWFPMNMDWRGRVYAVPMFNPQGNDMTKGLLTLAKGKPIGVDGYYWLKIHGANTAGVDKVDFAERIKFIDDNHENIMSVAADPIANTWWAEQDSPFCFLAFCFEYAGVQHHGMNYNCSLPLAFDGSCSGIQHFSAMLRDEVGGRAVNLLPSKEVQDIYRIVAERVNEMLREAVINGTDNEVETVTNKDTGEITEKLKLGTKELAGQWLAYGVTRKVTKRSVMTLAYGSKEYGFRDQVLEDTIQPAIDDGKGLMFTQPNQAAGYMAKLIWESVTVTVVAAVEAMNWLKSAAKLLAAEVKDKKTKEVLRKRCAVHWVTPDGFPVWQEYKKPVQTRLNLMFLGQIRLQPTVNTNKDSGIDARKQESGIAPNFVHSMDGSHLRMTVVRSNEVYGVESFALIHDSFGTIPADAGNLFKAVRETMVNTYEENDVLADFYEQFADQLHESQLDKMPEMPAKGSLDLQEILKSDFAFA

SEQ ID NO: 32 - protein, 906 aa, Klebsiella phage K11
MNALNIARNDFSEIELAAIPYNILSEHYGDKLAREQLALEHEAYELGEQRFLKMLERQVKAGEFADNAAAKPLVLTLHPQLTKRIDDWKEEQANARGKKPRAYYPIKHGVASKLAVSMGAEVLKEKRGVSSEAIALLTIKVVLGTLTDASKATIQQVSSQLGKALEDEARFGRIREQEAAYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVETVGGGYWSVGRRPLALVRTHSKKALRRYADVHMPEVYKAVNLAQNTPWKVNKKVLAVVNEIVNWKHCPVGDVPAIEREELPPRPDDIDTNEVARKAWRKEAAAVYRKDKARQSRRLSMEFMVAQANKFANHKAIWFPYNMDWRGRVYAVSMFNPQGNDMTKGMLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFHEKVTLGESVLAAQWLQYGVTRKVTKRSVMTLAYGSKEFGFRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSFGTIPADAGNLFKAVRETMVKTYEDNDVIADFYDQFADQLHESQLDKMPAVPAKGDLNLRDILESDFAFA

SEQ ID NO: 33 - protein, 906 aa, Klebsiella phage KP32
MNALNIARNDFSEIELAAIPYNILSEHYGDKLAREQLALEHEAYELGEQRFLKMLERQVKAGEFADNVAAKPLVLTLHPQLTKRIDDWKEEQANARGKKPRAYYPIKHGVASELALSMGAEVLNEKRGVSSEAIALLTIKVVLGTLTDASKATIQQVSSQLGKALEDEARFGRIREQEATYFKKNVADQLDKRVGHVYKKAFMQVVEADMISKGMLGGDNWSSWKTDEQMHVGTKLLELLIEGTGLVEMTKNKMADGSDDVTSMQMVQLAPAFVELLSKRAGALAGISPMYQPCVVPPKPWVETVGGGYWSVGRRPLALVRTHSKKALRRYADVHMPEVYKAVNLAQNTPWKVNKKVLAVVNEIINWKHCPVGDVPAIEREELPPRPDDIDTNEVARKAWRKEAAAVYRKDKARQSRRLSMEFMVAQANKFANHKAIWFPYNMDWRGRVYAVSMFNPQGNDMTKGMLTLAKGKPIGLDGFYWLKIHGANCAGVDKVPFPERIKFIEENEGNILASAADPLNNTWWTTQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFREKVTLGESVLAAQWLQYGVTRKVTKRSVMTLAYGSKEFGFRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSFGTIPADAGNLFKAVRETMVKTYEDNDVIADFYDQFADQLHESQLDKMPAAPAKGDLNLRDILESDFAFA

SEQ ID NO: 34 - protein, 906 aa, Klebsiella phage vB_KpnP_KpV766
MNALNIARNDFSEIELAAIPYNILSEHYGDKLAREQLALEHEAYELGEQRFLKMLERQVKAGEFADNVAAKPLVLTLHPQLTKRIDDWKEEQANARGKKPRAYYPIKHGVASELAISMGAEVLNEKRGVSSEAIALLTIKVVLGTLTDASKATIQQVSSQLGKALEDEARFGRIREQEATYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVGTVGGGYWSVGRRPLALVRTHSKKALRRYEDVHMPEVYKAVNIAQNTPWKVNKKVLAVVNEIVNWKHCPVADVPAIEREELPPRPDDIDTNEVSRKAWRKEAAAVYRKDKARQSRRLSMEFMVAQANKFANHKAIWFPYNMDWRGRVYAVSMLNPQGNDMTKGMLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFREKVTLGESVLAAQWLQYGVTRKVTKRSVMTLAYGSKEFGFRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYHKRDQARLKLTFLGQANVFMTYNKGDTKEIDAHKQESGIAPNFVHSQDGSHLRMTVVHANEVYGIDSFALIHDSFGTIPADAGNLFKAVRETMVKTYEDNDVIADFYDQFADQLHESQLDKMPEVPAKGDLNLHDILESDFAFA

SEQ ID NO: 35 - protein, 884 aa, Enterobacteria phage T3
MNIIENIEKNDFSEIELAAIPFNTLADHYGSALAKEQLALEHESYELGERRFLKMLERQAKAGEIADNAAAKPLLATLLPKLTTRIVEWLEEYASKKGRKPSAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVAITGGGYWANGRRPLALVRTHSKKGLMRYEDVYMPEVYKAVNLAQNTAWKINKKVLAVVNEIVNWKNCPVADIPSLERQELPPKPDDIDTNEAALKEWKKAAAGIYRLDKARVSRRISLEFMLEQANKFASKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVTHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVITYENNDVLADFYSQFADQLHETQLDKMPPLPKKGNLNLQDILKSDFAFA

SEQ ID NO: 36 - protein, 884 aa, Serratia phage SM9-3Y
MNIIETIEKNDFSEIELAAIPFNTLADHYGSSLAREQLALEHESYELGERRFLKMLERQAKAGEIADNAAAKPLLATLLPKLTARIVEWLEEYASKKGRKPVAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVSITGGGYWANGRRPLALIRTHSKKGLMRYEDVYMPEVYKAVNIAQNTAWKINKKVLAVVNEIVNWKNCPVADIPSLERQELPPKPEDIDTNEAALKEWKKAAAGIYRLDKARVSRRISLEFMLEQANKFANKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVAHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVLTYENNDVLADFYDQFADQLHETQLDKMPPLPKKGNLNLQDILKSDFAFA

SEQ ID NO: 37 - protein, 883 aa, Yersinia phage YpP-R
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVNLHRQNAGVVGQDSETIELTPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDTNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEDNHENIMACAKSPLENTWWAEQDSPFCFLAFCFEYAGVQHHGLSYNCSLPLAFDGSCSGIQHFSAMLLDEVGGLAVNLLPSATVQDIYGIVAKKVNVILQADVINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWEAVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLQDILKSDFAFA

SEQ ID NO: 38 - protein, 877 aa, Pectobacterium phage PP99
MYTSDELYQKQLELEGEMHGYGVTRFDRNNQRAIDSGTPSDTDWNRRLLSNFIEPMVKGINAYKGYYKTKAGRPTVALKYIRQVQPEQAAYIAIKNILDVLGSTTFDANWLVTTIGRRIEDQVRFTKLEEAAPKYVGKVKDSLAKRNSLQYAHQHKVLVATEKKLAENPDRAQLELPRWQEWAEEDCKHVGSLLVNIFEQCILFEGEPVIRKEVQTVRKGTLVFIKPTEKVTKWIHEFREAIGGLAPAYAPCVVPPLDWTSPFTGGFHTEAVSSTLHLAKVRNKRHLRKLTKEQMPAVYKAVNNLQKVRWRISERVLATANTLVELGLPYALPSKDESDWKEKNPCPVPEYLQDLRGEQLKAALTASQWEAFQEWKQLARQNYDEESERVASFREVVRTLGQANRYVGFDAIYFVYTLDFRGRVYCQSSLVSPQGGDLQKALIKFADGMKLGERGEYWFKVHGANEWGWDKKEFDERVALVSEPEFCEMCLDIASDPVTFNDWIKADKPWQFLNWCFEYADFLKHVQSDGNPQDFVSYIPCAMDGSCSGIQHYSAMLRDTVGGTAVNLVNSDKPNDIYGEVCKVSIKELQAIADGSQAYDGKIDPILAQQLAQEWLRLQPNRSLTKKPVMTLPYGSTQLTCREHVSQWLKDLQKEENKRAKAEFREPMKVHAFGDADSAMPLKFAESLMTSIVWHSIGKVVVAARAGMAYIKAVTSSVAKMNMPLEWTTPTGFIVRQEIYQFTTRQVNTQLLGGTKFVVSTKSKDIDYHRMINSCAPNFVHSMDASHLTLATNYFADAGISSIAVIHDSFGTHAGATDLLRERLRASMVDMYEQHDVITNFLAETEGRLMTAFEHIRVPERGELQLDSINQSTYAFA

SEQ ID NO: 39 - protein, 816 aa, Aeromonas phage 25AhydR2PP
MATLQDQLEWETYQRDLGRTKLEQQLRKAEEKGRIAETPLGSSVLRRYVLWMSERLSKDITEDLGKAGRSKAYSPLLHALDPDAVSLLAITTLIELVCARKEGFIHLGFLASEIGRRVYGELALASFRDINPELYEALTKDLQKKMSQDLRHKLTVFRMQAQKAGIELPEWTPSQKAQVGSYLVSLMEKQSGDPKYLCELDSVATGHKSAYVVYLSQHVQELMAEIEDRMMLKAGFAAPCLIPPQPWDADGTQGGFYGDLKVRAVRFFKGSSEQWEIMRTEGHDPTVVLGMLDAVQHVAWKVNPFILDLIKKMRAKGLETKTVRTTAALPKPERPLFLDLQDGALTPEQEELKKQWKRQMRDWHTEIRKVSRIEARLGVALAAAEEMSKHDRFYFAHQVCDRFRMYPVSGPLSPQGADNQKALLHSADGGPIDSNEALYWFKLNIAAKFGIDKLSPEECIKWVDDNETSIISAASDPTSRDAFYWWSQADKPLQFIAVCDELRSYKLDPANFVARIACAMDGTCNGLQNYSALLRDEVGGRATNLISTSDGVPADIYGDVARASWLRLLESDECPFRTSWMAHGFNRKLTKPSVMTQVYGSTYGTCRKSILSYCIENELFDGEEYPHSDYAGKLVWAGIDDVVVKAKEAMKWLRESAGAVMREGAQYITWIAPSGARVVQIYNKFDELRVWTHVGNKIRLQLKGPEHPDKPDKMRHRNAFPPNFIHSVDASHMALVAVRMVKEFGLGVFLHFIHDDFGALPHQAATLAGVIREEFVRMHQSYSLEHIREQYPFLSVPPKRGNLDINCVLDSVNFFR

SEQ ID NO: 40 - protein, 883 aa, Stenotrophomonas phage IME15
MTVIAIEKNDFSDVELAVIPFNTLADHYGEKLAREQLALEHEAYEMGEARFRKIFERQLKAGEVADNAAAKPLVATLLPKMIERIHAWFEEVSAKRGKRPTAFKFLQEVKPEAIAYITIKTVLGTLTSAEQTTVQAAASAVGRAIEDEARFGRIRDLEAKHFKKNVEEQLNKRVGHVYKKAFLQVVEADMLSKGLMGGEAWSSWHKEDSIHVGVRCIEMLIEATGLVVLERQNAGVVGADAETLSLASEYADAIATRAGALAGISPMYQPCVVPPKPWTTVTGGGYWANGRRPLALVRTHGKKALMRYEDVYMPEVYKAVNLAQSTAWKINKKVLAVANEITKWKHCPVEDIPAIEREELPVKPDDIDENPEALTNWKRAAAAVYRKDKARKSRRLSLEFMLEQANKFANHKAIWFPYNMDWRGRVYAVSMFNPQGNDMTKGLLTLAKGKAIGKEGFYWLKIHGANCAGVDKVPFPERIKFIEDNHEHIMASAKNPLEYTWWAEQDSPFCFLAFCFEYAGVMHHGLSYNCSLPLAFDGSCSGIQHFSAMLRDEVGGRAVNLLPSETVQDIYGIVAKKVNEIMQRDVISGTDDELVTETDKTTGEITEKAVLGTRTLAGQWLAYGANRSVTKRSVMTLAYGSKEFGFRQQVLEDTIRPAIDSGKGLMFTIPNQAAGYMAKLIWDSVSVTVVAAVEAMKWLQSAAKLLAAEVKDKKTGEVLRNRCAVHWVTPDGFPVWQEYRKPLQTRLNLMFLGQFRLQPTINTNKDSGIDAHKQESGIAPNFVHSQDGSHLRKTVVWAHEKYGIESFALIHDSFGTIPADAGNLFKAVRETMVDTYENCDVLADFYEQFADQLHESQLDKMPALPKKGNLNLRDILESDFAFA

SEQ ID NO: 41 - protein, 883 aa, Escherichia phage T7
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 42 - protein, 818 aa, Artificial Sequence
  Yersinia phage phiR8-01 RNA polymerase + N-terminal His6 tag
MHHHHHHGSITLEQQLAWEHKHRELGRDKVMESLRKAEEQGRVTDTPLGTGVLRKYIMWLSQRIATDLTVDLGKPGRSKAHSPLLKDLDPDSVALITISSVINTLSQDNRGLSAVAMQIGKTIYGELALCYFRDMKEDLYEAMVHDLTKKMSKDLRHRLTVMRMQAEKAGVSIPEWTPSQKLQVGLYLLSLIDGEDGLVEQYTDFTNKKTTYKLQLRPAVMQLMNSAESSILAHAGFAAPCLIQPQDWDGDGVGGFYGDLKIRAPRFFKGDSYQMEVMKKLGCDLRVVLGMLNAHQSVAWKVNPFILDLVKGMRLRGYETDDVMFTSAHPEPPRPLFLDLADKIGMTVPQEVEFKQWKQTKRDWHTKIRLVSRAEAKLSRVIYAAQDMLEYSEFFFVFQTDDRGRMYPVSGPLNPQGSDMQKAMLHAAHGEPIADKVAEKWFKLNLATKYGVDKLNIDQCVQWTIDNHDNIMRAAEDPLNRDAFYWWSEADKPLQFIALCDEYRRYHLDPVNFVARIAVAMDGTCNGLQNYSALLRDEVGGRATNLIGEDGDAPNDIYGDVAVAAEKRLQYAEECAAKLAWLKEGFNRGLTKKSVMTQVYGSTFGTCRKSIVAYCVEKALFEDKERWEFADFASHLVWEGIGDVVVKGKEAMDWLRKVSGCAMKTGDDYISWPAPSGFRVVQVYRKSEVKRVQAQVGNKITLRLREETDLPDKIRHRNATPPNFIHSVDASHMAFVSVRMYLMFPGLFMHMIHDDFGALPSKAQALYDTIRSEFVQMHENYSLDCFVSEYGHRVKLPPVPERGSLDIRCVLTSPNFFR

SEQ ID NO: 43 - protein, 824 aa, Artificial Sequence
  Aeromonas phage phiAS7 RNA polymerase + N-terminal His6 tag
MHHHHHHGSATLQDQLAWETYQRDLGRTKLEQQLRKAEEKGRIADTPLGSSVLRRYVLWMSERLAKDITEDLGKAGRSKAYSPLLHALDPDAVSLLAITTLVESVCSRKEGYIHLGFLASEIGRRVYGELALASFRDINPELYEALTKDLQSKMSQDLRHKLTVFRMQAQKAGIELPEWTPSQKAQVGSYLVSLMEKQSGDPKYLCELDTVATGHKSAYVVYLSKHVHELMAEIEDRMMLKAGFAAPCLIPPQPWDADGTQGGFYGDLKVRAVRFFKGSSEQWEIMRSEGHDPAIVLGMLNAVQNVAWKVNPFILDLIKQMRAKGLETKTVRTTAALPKPERPLFLDLQDGALTPEQEEEKKRWKRKMRDWHTEVRKVSRIEARLAVAIAAAEEMLKHDRFYFTHQVCDRFRMYPVSGPLSPQGADNQKALLHSADGGPIDSDEALYWFKLNIAAKFGIDKLSPEDCVKWVDDNETNIIRAASDPAGRDAFHWWSQADKPLQFIAVCDEYRRYKLDPSGFVARIACAMDGTCNGLQNYSALLRDEVGGRATNLISAEDRVPADIYGDVARASWVRLLESVECPFRTAWMAHGFNRKLTKPSVMTQVYGSTYGTCRKSILSYCIENELFEDEEYEHADFAGKLVWAGIDDVVVKAKEAMKWLRESAGAVMREGANYITWLAPSGARVVQIYNKYDELRVWTHVGNKIRLQLRGPEHPDKPDKMRHRNAFPPNFIHSVDASHMAMVAVRMVKEFGLGVFLHLIHDDFGALPHQAGTLARVIREEFIAMHEGYSLERIREQYPFLAPVPQRGNLDINCVLDSVNFFR

SEQ ID NO: 44 - protein, 812 aa, Artificial Sequence
  Aquamicrobium phage P14 RNA polymerase + N-terminal His6 tag
MHHHHHHGSLTQEEIEREAYQHGRNRSAKTISRNEEEGRANANPYAQAIYRRFVLPLADMIKKDVSEKRTGRRQAHVQLLAPIDPLAVAFIAVRGVLNALLTDSDAGGRKVGHTVGASVYHEYCLSVFHEAEPDLFFAITNDLGRRMSKSERHRMTVYKMSAKANGVQFNEWGQGNVDQVGGYLIDCLEQLGMVYTSTGTMKRGRGFQHVINVELSSEVLTIVSRISDRFIETTPYFLPCVEKPKPWVSLDDGGFHTKEMRRLHPFMIRCRPGQRDHFRQADLSKEMECINALQETAWRVNKRLLDTVKKVSHHFDMDEILSMEDFPPPERPGFLDGMKEADMSADQLSQFKAWKRDMASWHTEMKLRGTRYGRFSTAVRVANQFVDYDELYFVYFADFRGRKYVQTTGISPQGSDLQKALLEFAKGEPLDTPEAVNWFKILGANKWGYDKASLMDRVAWVDSHHDQIIQFAQDPIGNYGWKDADSPLQFLAWCFEYEQWTKFPKYFLSRLPVSMDGTCNGLQNFSAMLRDELGGKATNLVPSDECQDIYAMVAEETTRLLVQEAPDENGYRDKWLAHGINRTLVKRSVMTLPYGSTRFSCADFINGDYLKAGLAPEFSRQEYSKAANYLSHIVWEAISTVVVKAREAMDWLQAAARQIIAEGHETISWVSPSGFPALQTYWEQEVHRVRSRLCGGAKLVLMSDTDKPSVRKHSNGIAPNFIHSMDAAHLTLTTVQSSTEGIHSLAMIHDDYGTHARYAGRLYSIIREVFVNIYESCDPLEELRSRYPFLPPVPDRGNLDINLVRESVYFFS

SEQ ID NO: 45 - protein, 813 aa, Artificial Sequence
  Caulobacter phage Percy RNA polymerase + N-terminal His6 tag
MHHHHHHGSLTQVELEAEMYAHGRHRAERMMSRNEDAGSANNNPYAPAIYRRFVLPLAELIREDVEHKRPGRRKAHATLLEPMNSEAVAYLAVRNVLNLMLMNANEDIRARNVATAVGKSVYHELMLSLFSEAEPDLFYTLVNDLGRRMSKSERHRMTVFKMQAKEAGVPFPEWGVAGVEQVGAYLLDQLEQLGMVTTWMTVIPGIGRAKPKKVYDIRLTPELVELIGAIKGNIIECTPYFLPCVEPPKPWTSVNSGGFHTKDMRRMQPFAVRSYGGWSEYAEHDMTMPLAAINALQSTAWKINTTMLETIRDVARHFDMDEILSQAEYPSPPRPEWLDGDMKFDQMTKDQQDEFVRWKREKSEWFTQMKLRGTKYGRFYAATTVAEKFASYPAIYFVYFADFRGRLYAQTTGVSPQGSDMQKSLIHFASGKPLATLEAERWFCIHGANKWGYDKASLDDRVKWVKDRHDLIMAFAENPVDNQGWTEADCPLQFLAWAMEYRDWQTAPHTFLSRIPVGLDGSCNGLQNFSAMLRDEVGGRATNLVPSALPNDIYQMVADVTALKLRQVEPDERGFRDKWLKHGMNRSLVKRSVMTLPYGSTRFSCADFIVGDYLKAGKATEFEKQEYQAAAQYLSHFVWDAIGEVVVKAREAMSWLQSSTKAILAEHGRITWTAPSGFPVFQMYVEQDMHRINTHLNGNAKIKVTVDNDKPDKSRHKNGVAPNFIHSYDAAHMTETAVYGSGEGMCLAMIHDDYGTHAADTERLFHLIRETFVSIYERCDPLVEFAAAYNLPDPPSRGSLDLRLVLESPYFFS

SEQ ID NO: 46 - protein, 844 aa, Artificial Sequence
  Xanthomonas phage f30-Xaj RNA polymerase + N-terminal His6 tag
MHHHHHHGSLSQVELEMETYAFGKERMEKSIARNEEQGGAGNNPYAQAVYRRFVLPLAERIRADIDSPRIGRAQAHVPLLRAKYDPERQNKRGQAVSAEEQAREWYEAVAFVAVRGALTSCMRDKHGEGSDRDVLKNVGINVYHEYLLTQFADAEPTLFYHLMNDMDRKLSVNENHRMTVMKMQGRKNGIEFVEWGQAQRDQVGAYLCDQLAQLGMLEIGVVTETAASAGAAYRKFQTKTHVKIVLTNEVRKLITQISDFVIEATPFYLPCVAPPMDWVDIDNGGFHTKEMRRLNPWMVKTYAQTRDEYRAAELRNEMAAINALQRVPWRINKRLMEAVSAIAKVHDMEEIISQGELPKPRKPEWLTKDMTKETMSHNQELEFKQWKRDMSNWHTDERLRQNKGNRFYNAMKVARKFAEYPSIYFVYFADFRGRKYVQTTGVSPQGSDLQKALLEFADGKPLLTKDAKDWFCITGANRWGYDKASLPNRVKWVAEHHDQIMAFAADPVHNDEWKTADKPLQFLSWCMEYEQWQVSGDRFLSRIAVGMDGSCNGLQNFSAMLRDAAGGVATNLIPAPLPNDIYQMVADRVTAILLGEDDDAEGYRTLWLGHGLTRSLVKRSVMTLPYGSRQSSWADFIIEDYLKCGKFPSLDKALYGPAARFLSKRMGEAIADTVVAAAGAMEWLQRGSGSILNQGYDRIRWITPSGFPVVQVYWESEEHRINTKLCGNAKLSLRKSTDAVKKSRHRNGIAPNFVHSLDASHLTLVVNAAKAEGIDAFAMIHDDFGTHAADSAALYRIIREVFVSMYERHDVLSAFHSAYPFLPEPPPMGELDLRQVLDSPYFFS

SEQ ID NO: 47 - protein, 839 aa, Artificial Sequence
  Burkholderia phage Bp-AMP4 RNA polymerase + N-terminal His6 tag
MHHHHHHGSTQAYEFVGPFESPQRALEREISREGRERALRRMEENEQHGRAEMNPYARPIYRRYLLPLIDAIRESVAGTGKAGRRKAHVALLKPLDPAAVAFIAVRTALVSLLNKSDSDDARVIGRFIGVAVYNELVFSLFENANPELYWEIVKDIERRNSTDARYKYRIIRDSANKRDMELPDWSPADREQVGLFLIEQLRLLGMVEVEREHINLSGGRIREKFTIDFTDDALGIIGNVKNMVELTTPLHLPFIEPPKPWTAFNRGGYHTDAMRRLSPYCISAPRVKKREVLDIYRNADLTKVRAAINKLQSVRWQINSDMLDTVREIARYTETEEVLKQADIDPPARPEWLPLDKDALKFEDMTEQQQEAFKAWKRRMRDWHNAKRSRGTKFKRFYSATSVADRFKGYDAIYFMYQADFRGRLYAVTTGVSPQGSDLQKCLLRFADGKPLADADAVRWFKVNGANRFGVDKVPFDDRVRWVDDNDEGIVACADDPVSHDWWRDADSPLQFLAWAKEYAAWRRDPANFVSRIPVGMDGSCNGLQHFSAMLRDEVGGRATNLLPGAKPNDIYQQVADVVTRKLAGLKLDQLPERDQGYAAKWISHGMNRKLVKRSVMTLPYGSTRFSCAQFIVDDYLKAGVAPQFEQSEYRHAANFLSHLVWDSIGQVVVAASAAMSWLQKCASTLIRRGASQIRWSAPSGFPVVQVYNKSDVIAVNSLLLGGVRIKVGSMTEDPDVNHHKNGMAPNFVHSMDAAHLTLTVNECDRVGIDSLAMIHDDYGTHAADAQRLFEVIRDTFVRMYEQNNPLAWFRDHYDGLPEIPKAGSLDIEQVRHSPYFFA

SEQ ID NO: 48 - protein, 811 aa, Artificial Sequence
  Pseudomonas phage Bf7 RNA polymerase + N-terminal His6 tag
MHHHHHHGSNQADLEREMADGGRRAAMARFQTAEAANDAASNPYAAAIFRRFIKPLSEGLDVYLHKAVRGVAAKSKVLLRGQDTLALAYITIRGVINASLSEGEAVFAGVAMDIGRTVYSEVALRQFEDLNPELYYTLVQDLERRMTKSERHRFNVMRSSAEKDGTPLPIWEPALKMDVGTLLLGASLDIGLIETFDLRLKGKTTKHLRLHPDLLALVEQIKGFVAGASPFNLPCVEPPKPWVTPTDGGWHTMAMRRTLPCMVRGQATATVEDVGPRVLKALNKVQSVAWEVNERILEVAEFAREHFDVQDVLVSDKRGGMPDKPLFMQADPVLKIVDMNEFELAQFTEWRQEAREWHTQQKVRGAHAGSTNEAIRVANKYKGKPLWFVYSVDYRSRFYASGQGLSPQGNDLSKALIHFARSAPIRTSAGLFWFRVAGANKWAVNKLDKQPLDVRAQWVIDNADFICRIADDPISHREWTDADVPFQFLAWCFEYAAWVRNPESFRTRIPLGQDGSCNGLQHFSAMLRDRVGGRATNLIPDRVQHDIYGLVATATAGIVQSDIDECDIAKRWKSHELSRSLVKRSVMTLPYGSTRHSCRDFIMKEYMDKGSAPEFDKRENEPAARWLSYRVWDGIGKVVVKGRQAMEWLQAASAIMCAGNAPHIEWRNPAGFLVRQRYHAREMLRVSCHSLSGKRIRINVQTFKDEGDPRRHRNGIAPNFVHSCDAAHLTFFTNDWEDEDGGDLALVHDDYGALADEVPKLHRILRRSFVDMYLYHDPLKALAAQVEGLPELPEAGDLNLEDVTRSVYFFC

SEQ ID NO: 49 - protein, 811 aa, Artificial Sequence
  Pseudomonas phage Andromeda RNA polymerase + N-terminal His6 tag
MHHHHHHGSNQAELEREMADGGRRAAMARFETAESANDAASNPYAAAIFRRFIKPLSEGLDVYLHKAVRGVAAKSKVLLRGQDTLALAYITIRGVINASLSEGEAVFAGVAMEIGRTVYSEVALRQFEDLNPELYYTLVQDLERRMTKSERHRFNVMRSSAEKDGTPLPVWEPALKMDVGTLLLGASLDIGLIETFDLRMKGKTTKHLRLHPDLLELIEQIKGFVAGASPFNLPCVEPPKPWVTPMDGGWHTNAMRRTLPCMVRGQASATIEDVGPRVLKALNKVQSVAWEVNERILEVAEFAREHFDVQDVLVSDKRGGMPDKPLFMQADPDLKIVDMNEFELAQFTEWRQEAREWHTQQKVRGAHAGSTNEAIRVANKYKGNPLWFVYSVDYRSRFYASGQGLSPQGNDLSKALIHFAKSAPIRTSAGLFWFRVAGANKWAVDKLDKKPLDVRAQWVIDNEEFISRIADDPISHREWTDADVPFQFLAWCFEYAAWRKDPESFRTRIPLGQDGSCNGLQHFSAMLRDRVGGRATNLIPDTVQHDIYGLVATATAGIVQADIDECDIAKRWKSHELSRSLVKRSVMTLPYGSTRHSCRDFIMKEYMDKGSAPEFDKRENEPAARWLSYRVWDGIGEVVVKGRQAMEWLQAASAIMCAGNAPHIEWRNPAGFLVRQRYHAREMLRVSCHSLSGKRIRINVQTFRDEGDPRRHRNGIAPNFVHSCDAAHLTFFTNDWEDEDGGDLALVHDDYGALADEVPKLHRILRRSFVDMYLYHDPLKALAAQVEGLPELPESGDLDLEEVNRSVYFFC

SEQ ID NO: 50 - protein, 787 aa, Artificial Sequence
  Cyanophage Syn5 RNA polymerase + N-terminal His6 tag
MHHHHHHGSSFDLIARQLQRETEAAELARKRLQDARREANERSYASSNIESRKAIATFLDPIAQRIGERLFTLRRGTGAVDAAEVYKHLKNADHHHLALITMKTALDVLGKDPEPQIQQLTTAIGRNIQLELRLTYYAEENPELYKQASRFFHAGTGTRQKATVIKLKFNREGIEWDQWSRVTCHKVGQWLMLAMADVTGWIERATDRTSGGRKTKTRICYSREFLQHRDTILAAAEQLAFCQWPMLCPPIEWSNDHNGGYLSEQIRRVNPLIRKTGPLGTRKQGDIPLAMLNNLQGQAYKVNPEVLDIANHCYESNVTVGKFIRHAPLPVPPSPGEDCTEDQLTAYKRARREAEDFNAQISQKNWRTTEVMYVARKYADEASFWMPASFDYRGRVYFLNTALNPQGTDFDKALLYFAEEGPVNEWWLSFHVATTYGLDKETMVNRVQWARDNHELIDRIASDPVRHTEWHDADEPWCFLAACLEYKACVIDGTKQTSGLPIGIDATCSGLQHLAAMTRCGRTAALVNVTPTDKPADAYKTVAQASLKHLPKEQHEWITRKVTKRPVMCTPYGVTMSSARGYIRDQLVKDGHKEDLRSPGVLNGIVKAIFNEAIPEVIPGPVQVMAWLKRSAGQIIDRGDSTITWTTPSGFEVVQDLKKSKTYEVKTRIMGGARIKLQVGDGFTDEPDRDHHKSALAPNVVHSNDASLLHLTFAFWDKPFTVIHDCVLGRSCDMDQMGSDIRLHFAEMYKADVMQDWADQVGVELPVDLIKNTLDIDSVNQSLYFFS

SEQ ID NO: 51 - protein, 818 aa, Artificial Sequence
  Pantoea phage LIMEzero RNA polymerase + N-terminal His6 tag
MHHHHHHGSTDLIAKQISMEEEARRRHRQGWLDNINEAMSSGRAGSVPLLHRMMIEAFPKVEEAMQSVFQDSTRGYGAQYRSLLRELGVKECASLALSMAVSGAAAEQTVIATLKGMGQAVVAEVVYKRAAAAGEVQAAYMDRVKVDNRKAKSKDPQHIIAKVRKSAQNVGEDPMMLPQRAFITIGKLMMKCVAGTGLVETDRRGGNARMGGMAHFVLHEDVLSTLNDWMDLPRADGGCYPPMLVPPVQIAEDGRSGMWQSPGQRDQYRVISRMNRREYRALKIDPTPVIEPCMALSSVPYRINPLVLELLQRSRTDVMGLPVMPVEPKLPFQIPAGVTFAQYISKFPEPMQQQMDAEAHEFKVRTRIYHTNMRKFMSQMMALNAAVAEAQRYAEFDKVYLPTYADTRGRIYYSSTLNPQGIDGVRALLELAEPVALGDDGLYWLKVHIANSFGYDATDFDDRAKWTDKALPRLREACRIPEAYDSFWSEADSPITAWAAAVELLRAIDSGNPATYMCRVVTQWDATCSGLQHLSAMLRDSVGGAAVNLLDSPGRKADIYLKVADSALEGLRRSELVSSSPLGQWLLRVGVPRAWAKKPVMTYVYGATKHGMIDYYCLMLRESKTPLPEGFRLMQCATFIANLMWDAIPRVVPAAARLMAWLQEIANTTGKEGEYVTFTAPSGLRVPNQYQMYRETSMRLNLLGVHAIQLREAQDRPDPRKCEAAFAPNFVHAMDASHMMRVLHQLWNNGIYMVSIHDSFGCAAAHAGTLHRIIREEFVRMYQQYNPIAELAREYNRTCPEPGDLDISNVLKSSKFFC

SEQ ID NO: 52 - protein, 831 aa, Artificial Sequence
  Acinetobacter phage Petty RNA polymerase + N-terminal His6 tag
MHHHHHHGSQDLYERQLALEEEYSNASLAAGQQVVLDAFKQGRAADISAGRVLLAKAFEAGLEQFTVALAKPSRGLAGKYRKLLHYAPPDVLVMAGLREVINACASAEPVSMQYVLTRVGRIIEAESMLACMQQVNAQYTNRTVQYLDSAGTKSITHRYRTFLSGAQNMGMDWEIWSNTERVQVARILLTELYEATGLFKWVTPQYNSSHTQYYLEPSEALAKHFQDIQSAARAVIKYPPMLIKPMDWEGYMNGGYLTEWFRHNSPMCSLRYVRQIDRNWIVKGLSDEAAQPVRDAMNKAQSTAYRVNKQVLEVLRKATAMRVGILGLPSFAELPQPEFPLADGWQKDDATESELEIFQLWKSRMAAWYTAENKRKGRHTGILIKLRELTRYKDEEALYFPTFIDWRGRLYFRSALNPQANDAVKGCLEFANGKPLGKDGLFWLKVHVANCCGYDKHDPELKAKWTDENWTQIEDFINNPLDVDAPEPDTAFTLLQAGLALQAALSLENPEAYVCHVPVAMDATCSGLQHLSALTRDPVGAYYTNLIDNGTDKKSDIYLRVASVADETKADFCLRKKTIKGKVENVADLVLEHYWKERSISRNMAKKPVMTFVYGSTLLSTIESIALDMSEGGMPVIEEDGKVIYSHTALATPIGKALRRGVLETVPEAAKMMSYLQKIVRSHKDQCMRWFTPVGVPVVNWTEGTTDKRINIRSMGVEKVLMIFRTGEYDTRRAANGIVPNFVHSMDSAHLCATINHFEGDVLPIHDSFATHPSDVSALHTSLRSTFVELYQNFKIEDFLEFNSVDYEEHTPPPQGNLDLSHVINSRYMFG

SEQ ID NO: 53 - protein, 826 aa, Artificial Sequence
  Pantoea phage LIMElight RNA polymerase + N-terminal His6 tag
MHHHHHHGSQTAENSMNITESKVERQLEIENKARTRAIDRSRKAVKDALDSGRASELLPVSRLISAAFSTVSDEIDKIKAEKAPGVGGKYRKFLKLVSTDVLATGSMVYVLDSLCHESQAKSSAQALMAGLGRFVQAEVLNRNLEIAAPAYINRVHEYMKEKHTRSQSHIMRTLRASADAVKLEHDPWSNTECIAVGRLLMQAVWETGLFKWHSHSNQMNYLLPGDQLEKVLTDVVTHSSMMMIAPPMIVPPQDHTTIHDGGYMTDIDRRGTYKNRHITNKQRRDVAKQFASDEAQPLRAAMNKAQNVPYRVNRSVLGWVQAARAQGIGIGMPSTKGRPKPEWRLDGIPKEQYDARELEDFEEWKAVTRQWYTEERKRVSQLRGMAMTIDMCEEYKDEQVLYFPTCVDWRYRLYFKSALNPQGSDLQKALLEFGTGRPLGDRGLHWLKVNVATTFGYDKPLFEERAAWVDLHYAEIERVADAPFETDSFKNADSPWCFLAACIELVNAVRSGCPAEYVSHAPVAMDATNSGGQHFSAMLRDEIGGRLTNLFWNGNTEKADLYMNVKERTDSKVIVAQRNADTVVQATYWRENEITRSMTKRPAMTFFYSATVRSCSDYIMLGALDEGYQPLQDFSMMKLSGFLAPLMRESIEEAMPAAAKAMKFAQQVCRTIPLENHLQWNTPLGGLIINRYTTTEEKRVNIRSMGLTQVVAYNRNYDLNNRRKAASGIAPNFVHGQDSTHLMMVILRHSGYIVPIHDSVATHACDVDEMHKHLREAFCDLYTSTDPLQTLKEAAEAAGGDCSEIDMPEHGTLNLELVKDSPFFFC

SEQ ID NO: 54 - protein, 893 aa, Artificial Sequence
  Erwinia amylovora phage Era103 RNA polymerase + N-terminal His6 tag
MHHHHHHGSNADLMQAQIELENNYFNGGIARFEASQARHENNGESSQTAWNRRLISEFVAPMAEALQVHKEFYSKKKGKPSKSLAYLQCVGNEVASYITMKVALDMLASGVSYTAIAMTIATRIEDQARFTKLEGAAEKYVAKVLDNLKRNSSKQYQHGHNVMVAAERKLSEGRPGQEPSVTRWIAWPQDDLLAIGMTLLQIMEKSVFFEGEPVFFRYNKNDNGGGKVKLIPVLGVADNVNAWIEAFKEHVSVMSPAYGPCVVPPRDWKTPFNGGFHTEAVASRVRFVKGRTDHVRKLTQKQMPKVYKAINFLQSVKWSINTDTLETAQEILAKNLGLGMPSFAPIITRDNKPACPLPLEFQHLRGEELRQSLTPTQWDSFLAWKGDCSKLYTMETKRTSKASAVARMLNQASDLAKFESIYFVYAMDSRGRVYVQSSGVSPQSDDLGKSLLRSTKGKTLDSSEALHWFLVLGGNLWGWDKKPFDVRVSHVLDEDFADMVRDVATDPLTFRNWLSADEPWQFLAWAKEYARYLDAVDDGTSAEFVTYLPVHQDGSCSGIQHYSAMLRDKTGAKAVNLMPSDTPQDIYGEVAKVVIRKNKAIADMADSEQEGYSIGKMKLSVAVSKAMAESWDAIGITRSLTKKPVMTLPYGSTRITCRESIDDYLVSLEEDELRKAKAEGRERNAVHPFESEELEGLSYKNALNYMTSLVWPSISEVVRAPVVAMKAIRQLARAVTKLNEGLYWTTPTGFIVEQRIYATDNLRVSSYLMGRVRMSLTVETETIDEAAMMGAAAPNFVHSLDAAHLISAVCAMADAGLEFVAVIHDSFGTLACDTQVLRDSLRSEMVAQYADVNRLEMLVQENEGRLLQDFGISLPEMGDFDLTEILKSDYCFA

SEQ ID NO: 55 - protein, 883 aa, Artificial Sequence
  Proteus phage vB_PmiP_Pm5460 RNA polymerase + N-terminal His6 tag
MHHHHHHGSDLQEIQLQLENEMFNGGIRRFEADQQRHLQAGNASDTAWNRKLISEFIAPMAQGIQAYKEEYKGKIGRAPRALAFLNCVENEVSAYITMKVVMDMIQTDVTLQSIAMSIADRIEDQVRFSNLEGKAKKYFEKVKASLKASRSKQYAHGHKVMVVAEKNLAEKSEDIDRWIPWGKEELLNIGLTLLEILENSVFFNGEPVFFRTIRTMGYKKTLYFLQTSENIGEWVRAFKDHVAQLSPAYAPCVVPPRPWKSPFNGGFHTEKVASRIRLVKGDREHVRKLTQKQMPKVYKAINALQNTQWQVNKDILNVADEVVRLDLGYGVPHFKPLIDKDNKPANPVPVEFQHLRGRELKEVLSDEQWQAFIHWKGECAKLYTAETKRGSKSASVVRMLGQARKYSMFDAIYFVYAMDSRSRVYAQSSTLSPQSDDLGKSLLRFTEGRSINSVEDLKWFCINGANLWGWDKKTFDVRLNNVLQEDFQEMCRDIASDPLTFTQWVGADAPYQFLAWAFEYANYLDLVDEGRAHEFKTHLPVHQDGSCSGIQHYSAMLKDEVGARAVNLKPSDAPQDIYGEVAKVVIRKNNENMEASEEDFMTSGSMHLQGAVLRAMASSWDSVGITRGLTKKPVMTLPYGSTRITCRESVEDYLITLEEEEVKRAIAENRKANKVHPFVSDKEEGQILERDALNYMTALIWPSISEVVKAPIVAMRMIKQLARYASKRNEGLEYTLPTGFILKQKIMATEMLRVRTMLMGDIRMSLQVDTDVVDETAMSGASAPNFVHGHDASHLILTVCDLVDKGIKSIAVIHDSFGTHADNTVALRDSLRHKMVEMYENTNVLQKLLEEHEERWLVDTGIKVPEQGTFDIREILNSDYVFA

SEQ ID NO: 56 - protein, 883 aa, Artificial Sequence
  Proteus phage PM 93 RNA polymerase + N-terminal His6 tag
MHHHHHHGSDLQEIQLQLENEMFNGGIRRFEADQQRHLQAGNASDTAWNRKLISEFIAPMAQGIQAYKEEYKGKIGRAPRALAFLNCVENEVSAYITMKVVMDMIQTDVTLQSIAMSIADRIEDQVRFSNLEGKAKKYFEKVKASLKASRSKQYAHGHKVMVVAEKNLAEKSEDIDRWIPWGKEELLNIGLTLLEILENSVFFNGEPVFFRTIRTMGYKKTLYFLQTSENIGEWVRAFKDHVAQLSPAYAPCVVPPRPWKSPFNGGFHTEKVASRIRLVKGDREHVRKLTQKQMPKVYKAINALQNTKWQVNKEILNVADEVVRLDLGYGVPHFKPLIDKDNKPANPVPVEFQHLRGRELKEVLSDEQWQSFIHWKGECAKLYTAETKRGSKSASVVRMLGQARKYSMFDAIYFVYAMDSRSRVYAQSSTLSPQSDDLGKALLRFTEGRSINSVEDLKWFCINGANLWGWDKKTFDVRLNNVLQEDFQEMCRDIASDPLTFTQWVGADAPYQFLAWAFEYANYLDLVDEGRAHEFKTHLPVHQDGSCSGIQHYSAMLKDEVGARAVNLKPSDAPQDIYGEVAKVVIRKNNENMEASEEDFMTSGSMHLQGAVLRAMASSWDSVGITRGLTKKPVMTLPYGSTRITCRESVEDYLITLEEEEVKRAIAENRKANKVHPFVSDKEEGQILERDALNYMTALIWPSISEVVKAPIVAMRMIKQLARYASKRNEGLEYTLPTGFILKQKIMATEMLRVRTMLMGDIRMSLQVDTDVVDETAMSGASAPNFVHGHDASHLILTVCDLVDKGIKSIAVIHDSFGTHADNTVALRDSLRHKMVEMYENTNALQKLLEEHEERWLVDTGIKVPEQGTFDIREILNSDYVFA

SEQ ID NO: 57 - protein, 882 aa, Artificial Sequence
  Salmonella virus SP6 RNA polymerase + N-terminal His6 tag
MHHHHHHGSQDLHAIQLQLEEEMFNGGIRRFEADQQRQIAAGSESDTAWNRRLLSELIAPMAEGIQAYKEEYEGKKGRAPRALAFLQCVENEVAAYITMKVVMDMLNTDATLQAIAMSVAERIEDQVRFSKLEGHAAKYFEKVKKSLKASRTKSYRHAHNVAVVAEKSVAEKDADFDRWEAWPKETQLQIGTTLLEILEGSVFYNGEPVFMRAMRTYGGKTIYYLQTSESVGQWISAFKEHVAQLSPAYAPCVIPPRPWRTPFNGGFHTEKVASRIRLVKGNREHVRKLTQKQMPKVYKAINALQNTQWQINKDVLAVIEEVIRLDLGYGVPSFKPLIDKENKPANPVPVEFQHLRGRELKEMLSPEQWQQFINWKGECARLYTAETKRGSKSAAVVRMVGQARKYSAFESIYFVYAMDSRSRVYVQSSTLSPQSNDLGKALLRFTEGRPVNGVEALKWFCINGANLWGWDKKTFDVRVSNVLDEEFQDMCRDIAADPLTFTQWAKADAPYEFLAWCFEYAQYLDLVDEGRADEFRTHLPVHQDGSCSGIQHYSAMLRDEVGAKAVNLKPSDAPQDIYGAVAQVVIKKNALYMDADDATTFTSGSVTLSGTELRAMASAWDSIGITRSLTKKPVMTLPYGSTRLTCRESVIDYIVDLEEKEAQKAVAEGRTANKVHPFEDDRQDYLTPGAAYNYMTALIWPSISEVVKAPIVAMKMIRQLARFAAKRNEGLMYTLPTGFILEQKIMATEMLRVRTCLMGDIKMSLQVETDIVDEAAMMGAAAPNFVHGHDASHLILTVCELVDKGVTSIAVIHDSFGTHADNTLTLRVALKGQMVAMYIDGNALQKLLEEHEERWMVDTGIEVPEQGEFDLNEIMDSEYVFA

SEQ ID NO: 58 - protein, 883 aa, Artificial Sequence
  Lelliottia phage phD2B RNA polymerase + N-terminal His6 tag
MHHHHHHGSQDLHAIQLQFEEEMFNGGIRRFEADNQRVIASGNESETAWNRRLLSELIAPMAEGINAYKESYVGKRGKPALALAFLQCVENEVAAYITMKVVMDMLNTDVTLQAVAMTIAERIEDQVRFSKLDAHANKYFEKVKASLKASKSKQYRHGHRVMVAAEKSVSEKDADFDRWEAWPKETCLQIGATLLDILESSVFYQGEPVFFRAIRQNGVRSTYYLQTSETVGAWIEEFKEHVAQLAPAYAPCVVPPRDWKSPFNGGFHTEKVSSRVRLVKGAREHVRKLTVKQMPNVYKAINALQRTEWQVNTDVMKVADDVIRLNLGYGMPSFKPLIDKENKPLNPVPVEFQHLRGRELKEMLTAEQWDTFIAWKGECSRLYTAETKRGSKSAAVVRMVGQARKYSAFNAIHFVYAMDSRSRVYAQSSTLSPQSNDLGKALLRFTEKRALNGSQALKWFCVAGANLWGWDKKTFGVRVSNVLDGEFQDMCRDIAADPLTFTQWAGADEPYQFLAWAMEYANYLDLLDEDRQEEFRTQLPVHQDGSCSGIQHYSAMLKDSVGAAAVNLLPSDEPQDIYGRVAQVVIGKVAQHANALDADTFTSGKLTLTGDALRTMAASWDAIGITRGLTKKPVMTLPYGSTRITCREAVADYLIDLEEKEAQKAVAEGRGVNLVHPFGQAEGQMTEAMALNYMTALIWPSISEVVKAPIVAMKMIRALARFAAKRNEGLEYTLPTGFILQQKIMATDLLRVRTVLSGDIKMALRLQVDTDIVDESAMMGAAAPNFVHGHDASHLILSVCAMVDEGITSIAVIHDSFGTHADHTPDLRNALKGQMVEMYANTNALQKLLSEHEDRWMVDTKIEVPEQGDFDVNLIMESEYCFA

SEQ ID NO: 59 - protein, 885 aa, Artificial Sequence
  Escherichia phage ECBP5 RNA polymerase + N-terminal His6 tag
MHHHHHHGSYTSDELYQKQLELEGEMHGYGVTRFDRNNQRAIDSGTPSDTDWNRRLLSNFIEPMVKGINAYKEYYKTKAGRPTVALKYIRQVQPEQAAYIAIKNILDVLGSTTFDANWLVTTIGRRIEDQVRFTKLEEAAPKYVGKVKDSLAKRNSLQYAHQHKVLVATEKKLAENPDRAQLELPRWQEWAEEDCKHVGSLLVNIFEQCILFEGEPVIRKEVQTVRKGTLVFIKPTEKVTKWIHEFREAIGGLAPAYAPCVVPPLDWTSPFTGGFHTEAVSSTLHLAKVRNKRHLRKLTKEQMPAVYKAVNNLQKVRWRISERVLATANTLVELGLPYALPSKDESDWKEKNPCPVPEYLQDLRGEQLKAALTASQWEAFQEWKQLARQNYDEESERVASFREVVRTLGQANRYVGFDAIYFVYTLDFRGRVYCQSSLVSPQGGDLQKALIKFADGMKLGERGEYWFKVHGANEWGWDKKTFDERVALVSEPEFCEMCLDIASDPVTFNDWIKADKPWQFLNWCFEYADFLKHVQSAGNPQDFVSYIPCAMDGSCSGIQHYSAMLRDTVGGTAVNLVNSDKPNDIYGEVCKVTIKELQAIADGSQVYDSKIDPVLAQQLAQEWLRLQPNRSLTKKPVMTLPYGSTQLTCREHVSQWLKDLQKEENKRAKAEFREPMKVHAFGDADSAMPLKFAESLMTSIVWHSIGKVVVAARAGMAYIKAVTSSVAKMNMPLEWTTPTGFIVRQEIYQFTTRQVNTQLLGGTKFVVSTKSKDIDYHRMINSCAPNFVHSMDASHLTLATNYFADAGISSIAVIHDSFGTHAGATDLLRERLRASMVDMYEQHDVITNFLAETEGRLMTAFEHIRVPERGELQLDSINQSTYAFA

SEQ ID NO: 60 - protein, 867 aa, Artificial Sequence
  Delftia phage IME-DE1 RNA polymerase + N-terminal His6 tag
MHHHHHHGSEYNPLTELASLYGEDLAAEQLRLEAEAYSLGEKRFMEAMEFKAETGQAGDTRVARPLVAELLPKLSMKIIEFIAFQRNGKPGKKAAAFKYIQGIDPDRISYLAIRTALNLSVASELPVVQLCEAIGRDVEDEARFGRIREQDEKAFKQRIAPEILKRSADHFKRAYARAVEVSMKDAGDLGAWESWGSSNRVAVGFKMVELMIEIGILVLSDINPGNPKMHKKVITLSDEVSRWLSERAQFLAGCNPMWSPSVVPPKPWTGIHRGAYWGRGKSNPKFIRGLGKQARKRYYDVDLSNVMNAVNLIQSTPWKVNAKVLEVAREVSQWKHISIDGIASPEVVAKPVRLEGMDDDEKVLKTWKREAAKTWRKERARRSRRMAMELVLEQANRFVKYDRIWFPHNVDFRSRVYSIPSALSPQGNDLSKGLLMLADATPMGKDGEYWLRMHIANVAGLDKEPMDVRQKWTYDHEDLILETAENPLENLWWATEADSPFCFLAACLEYRNWKASHNPEAYVCGLPIAFDGSCSGIQHFSAMLRDEVGGAAVNLTPGERPSDIYRIVSDKVQEVINHDLIHGSDNVMTEQVCDETGDILERIQYGSKAVAKWWNDYGITRKVTKRSVMTLPYGSKKFGFADQLLEDIIMPAVDSKGEHVFPAPATAARYMADLIWTALETTVVAAVGAMAWLQKAAGALASQGMPATWTTPVGFPVWQEYKVKATKRVDTVICGSIRMTMTVELTEKTEENELDRHKQVSAISPNFVHSMDASHLMMTVLAAAEQGVQHFVMIHDSFGTCPGNAGAMFRVVRETMVKTYTENDVILGFYEGFAADLTEKNAEKIPALPPKGELNLEEILESRYCFC

SEQ ID NO: 61 - protein, 890 aa, Artificial Sequence
  Pseudomonas phage phi15 RNA polymerase + N-terminal His6 tag
MHHHHHHGSIEVAKNDFSDVKTDWAFRVLSELYGEELAAAQLALEHESHEIGEAKFKKALDRQMKRGETSETSVAKPLVAMLVPKFVEKMDAWVEHQMKNVRRKSVALKFIQMVATERVAVITIKTVINAMSQGDVVLQAIAGRIGRGIEEEARFGRIRDQEAKHFKKYIREALNKRNGHTYKRAYMHAVEDRMLEAGELNGAWSDWDNEDPTIIAHIGLRCIEALIESSGLVRITRRSAGNVKEDCNVLELEPQWVEMLNQRAFTLAGVNTYHQPCVVPPRPWTRPVGGGYWGKGRRPTRFIRVHNKKALERYRDVDMEAVYKAVNIAQNTAWSINKRILEVAEALASWTNVPISKWPKAETQELPVKPHDIETNEEARNAWKKQASGVYRSESSRVSRRMSLETTLETARKFADFEAIYFPHNLDWRGRVYALPVFNPQRDDLTKGLLQASKGEPVGEDGIKWLMIHGANTAGVDKVPFDERQQWVRDNERTILQCAEDPLTHTEWMSMDSPFCFLAFCFEWAGVVKDGPNHVSALPIAFDGSCSGIQHFSAMLRDETGGRAVNLLPSERVQDIYRLVSDGVNAALRDDAVHGTDDSTDVHVDEKTGEITERRVLGTRTLAAAWLAHGVDRSVTKRSVMTLAYGSKEFGFTDQVRDDIITPAVDAGSLNFPQPQQAARYMAHLIWVSVGKTVVAAVEAMEWLQKSAKLLAAIVKEKKGPEKGKILKPAMPVYWVTPDGFPVWQEYRVQQAKRIDMILMGDVRLTATVLHQQDQIDARKQESGISPNFVHSMDGNHLRQTVVHAHDAYDITFFALIHDSFGTIPAKAGQLFKAVRETMVTAYEHNDVLADFREQFIDQLHETQMDKMPELPKKGTLDIREILKSQFAFA

SEQ ID NO: 62 - protein, 891 aa, Artificial Sequence
  Vibrio phage VP3 RNA polymerase + N-terminal His6 tag
MHHHHHHGSANVIKPQSHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEYGVTRSVTKRSVMTLAYGSKEYGFADQVFEDTVMPAIDNGKGTMFTEPSQACRFMAKLIWDAVSKTVVAAVEAMQWLQSAAKLVSSEVKDKKSGEILKHAMPVHWTTPNGFPVWSEYCKQEQKVIDCVILGSMRLQLKLNMRDKKEIDTAKQASGIAPNFVHSMDASHLQMTVNKCFKVYGIHSFAMIHDSFGCHAGFASKMFRAVRETMVETYEEHDVIQEFYNQFEKQLHESQIEKMPALPRKGNLELREILKSLYTFS

SEQ ID NO: 63 - protein, 891 aa, Artificial Sequence
  Vibriophage VP4 RNA polymerase + N-terminal His6 tag
MHHHHHHGSANVIKPQSHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWTNCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEYGVTRSVTKRSVMTLAYGSKEYGFADQVFEDTVMPAIDNGKGTMFTEPSQACRFMAKLIWDAVSKTVVAAVEAMQWLQSAAKLVSSEVKDKKSGEILKHAMPVHWTTPNGFPVWSEYCKQEQKVIDCVILGSMRLQLKLNMRDKKEIDTAKQASGIAPNFVHSMDASHLQMTVNKCFKVYGIHSFAMIHDSFGCHAGFASKMFRAVRETMVETYEEHDVIQEFYNQFEKQLHESQIEKMPALPRKGNLELREILKSLYTFS

SEQ ID NO: 64 - protein, 891 aa, Artificial Sequence
  Vibrio phage ICP3_2008_A RNA polymerase + N-terminal His6 tag
MHHHHHHGSANVIKPESHNFSDISAAILPFNVLADSYGEALAAEQLMLEHESYQLGEARFIKAMERQVERGEVSDNAVAKPLLDTLIPALAARITEFIEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEHGVTRSVTKRSVMTLAYGSKEYGFADQVFEDTVMPAIDNGKGAMFTEPSQACRFMAKLIWDAVSKTVVAAVEAMQWLQSAAKLVSSEVKDKKSGEILKHAMPVHWTTPNGFPVWSEYCKQEQKRIDCVILGTHRMALTINIRDKKEIDAAKQTSGIAPNFVHSMDASHLQMTVNKCFKVYGIHSFAMIHDSFGCHAGFASKMFRAVRETMVETYEEHDVIQEFYNQFEQQLHESQIEKIPVLPRKGNLELREILKSLYTFS

SEQ ID NO: 65 - protein, 891 aa, Artificial Sequence
  Vibrio phage ICP3_2007_A RNA polymerase + N-terminal His6 tag
MHHHHHHGSTNVIKPESHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDNNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANIIASAEAPLDFTWWAEQDSPFCFLAFCFEWAAYVKAGKKPSFESSLPLAFDGTCSGLQHFSAMLRDEIGGAAVNLLPADKPQDIYDIVAVKVNEVLRDLVISGTEDEMQTLEDKKTGEITERLVLGTRTLAAQWLEYGVTRSVTKRSVMTLAYGSKEYGFADQVFEDTVMPAIDNGKGAMFTEPSQACRFMAKLIWDAVSKTVVAAVEAMQWLQSAAKLVSSEVKDKKSGEILKHAMPVHWTTPNGFPVWSEYCKQEQKRIDCVILGTHRMALTINIRDKKEIDAAKQTSGIAPNFVHSMDASHLQMTVNKCFKVYGIHSFAMIHDSFGCHAGFASKMFRAVRETMVETYEEHDVIQEFYNQFEQQLHESQIEKMPVLPRKGNLELREILKSLYTFS

SEQ ID NO: 66 - protein, 891 aa, Artificial Sequence
  Vibrio phage N4 RNA polymerase + N-terminal His6 tag
MHHHHHHGSANVIKPESHNFSDISAAILPFNVLADSYGEALAAEQLMLEHESYQLGEARFIKAMERQVERGEVSDNAVAKPLLDTLIPALAARITEFVEMKQRGKPHVSKGYFAMIKPESAAFIIVKTTLNILAKEESVPVQRVAMAIGGNIEDEIRFGRIRDEEIKHFKERVKPNLDKRNGFIYKKAYMEAVEAGMQDKGELNSTHEAWEKDVKFHVGIRAIEMLIEATGMVQLERKFKGIPDKDHEALHLAPEYVEKLTNRAHALAGISPMYQPMIVKPKRWTGVQGGGYWAKGRRPLNLIRVGSKRALDRYRQVDMPEVYDAINTIQETAWRINKDVLAVVNNVVTWANCPVEDVPSIDKLALPEKPEDIDSNEESLKKWKKAAAAIYRKEKARQSRRISLEFALSQANKFSKYNEIYFPYNMDWRGRVYAIPMFNPQGNDMVKGLLTFAKKVPVGIDGGYWLAVHGANCAGVDKVSLEDRVKWVNDNEANILASAEAPLDFTWWAEQDSPFCFLAFCFEWAAYVKAGKKPSFESSLPLAFDGTCSGLQHFSAMLRDEIGGAAVNLLPADKPQDIYGIVAVKVNEVLRDLVISGTEDEMQTLEDKKTGEITERLVLGTRTLAAQWLEYGVTRSVTKRSVMTLAYGSKEYGFADQVFEDTVMPAIDNGKGAMFTEPSQACRFMAKLIWDAVSKTVVAAVEAMQWLQSAAKLVSSEVKDKKSGEILKHAMPVHWTTPNGFPVWSEYCKQEQKRIDCVILGTHRMALTINIRDKKEIDAAKQTSGIAPNFVHSMDASHLQMTVNKCFKVYGIHSFAMIHDSFGCHAGFASKMFRAVRETMVETYEEHDVIQEFYNQFEQQLHESQIEKMPVLPRKGNLELREILKSLYTFS

SEQ ID NO: 67 - protein, 901 aa, Artificial Sequence
  Cronobacter phage Dev2 RNA polymerase + N-terminal His6 tag
MHHHHHHGSSVISIDKHDFSDVSNAIEPFNVLADHYGQDLAVKQLQLEHEAYTEGERRFIKNLERQTERGELADNQVAKPLMQTLVPTIAKAVREWHEGPDGKSSTSRPSVAFTMLSTDEKAVKDRSLRISSESAAVIILKVILSKLVKPEGIPITPMASAIGRTLEDEIRFGRIREQEQEHFKKTIAESLKKRAGASYKKAYMQAVEASMLEQGQLADAWGTWSPTEAVHVGIKMLELVIQSSQLVELKRYGAGNAAADVEMVHLSDFWVKKMAQRGFSLAGIAPVYQPCVVPPKPWTGVVGGGYWAKGRRPLPLIRLGSKAAVQRYEDVYMPEVYEAVNIIQQTPWKVNKKVLEVVNMVEKLNNTPIADIPQMEPLKPEDYAGETEEELKAWKKSAAGIYRREKARQSRRLSLSFIVSQANKFSQFKAIWFPYNMDWRGRVYAVPMFNPQGNDMQKGLLTLAVGKPIGADGFKWLKVHGANCAGVDKVTFEERIKWVEDNHDNIMAAAKAPMDSIGWWGQLDSPFCFLAFCFEYAGVMHHGLSYSCSLPIAFDGSCSGIQHFSAMLRDHVGGHAVNLTPSGKVQDIYRIVSDRVEEQLKELLVNGSDNEVKTFEDKKTGEITERLVLGTRELARQWLTYGMSRSVTKRSVMTLAYGSKEYGFADQVFEDTVMPAIDSGKGAMFTDPSQASRFMAKMIWDAVSVTVVAAVDAMKWLQGAAKLLAAEVKDKKTKEVLKPCLPVHWVTPDGFPVWQEYRKKDTTRLNLLFLGSFNLQPTVNKGSKKELDKHKQESGISPNFVHSQDGSHLRKTVVHTHRKYGVMSFAVIHDSFGTIPADAEFLFKGVRETMVETYRDNDVLQDFYEQFADQLHESQRDKLPELPKRGKLNIEDILLSDFAFA

SEQ ID NO: 68 - protein, 901 aa, Artificial Sequence
  Escherichia phage vB_EcoP_GA2A RNA polymerase + N-terminal His6 tag
MHHHHHHGSSVISIDKHDFSDVSNAIEPFNLLADHYGQDLAVKQLQLEHEAYTEGERRFIKNLERQTERGELADNQVAKPLMQTLVPKIAQAVKEWHEGPDGKLSTSRPSVAFTMLSTEEKAVKDRSLRISCESAAVIILKVILSKLVKPEGIPITPMASAIGRTLEDEIRFGRIRDKEQEHFKKAIAENLNKRAGASYKKAYMQAVETSMLEQGQLEDAWGTWSPTEAVHVGIKMLEIVIQSTQLVELKRYGAGNAATDVEMVHLSDFWVKKMAQRGFSLAGIAPVYQPCVVPPKPWTGVVGGGYWAKGRRPLPLIRLGSKSAVARYEDVYMPEVYDAVNIIQNTPWKVNKKVLDVVNMVEKLNNTPIDDIPQMEPLKPEDYAGETEEELKAWKKAAAGIYRREKARQSRRLSLSFIVNQANKFSQFKAIWFPYNMDWRGRVYAVPMFNPQGNDMQKGLLTLAVGKPIGADGFKWLKVHGANCAGVDKVTFEERIKWVEDNHDNIMTAAKAPMDSIEWWGKLDSPFCFLAFCFEYAGVMHHGLSYNCSLPIAFDGSCSGIQHFSAMLRDHIGGHAVNLTPSGKVQDIYRIVSDRIEEELKVLLINGTDNEMVTHEDKKTGEITERLKLGTRELARQWLTYGMSRKVTKRSVMTLAYGSKEYGFADQVYEDIVMPAIDSGSGAMFTEPSQASRFMAKMIWEAVSVTVVAAVDAMKWLQGAAKLLAAEVKDKKTGEILKPCLPVHWVTPDGFPVWQEYRKKDTTRLNLMFLGSFNLQPTVNKGSKKELDKHKQESGISPNFVHSQDGSHLRKTVVHTHSKYGVMSFAVIHDSFGTIPADAEFLFKGVRETMVETYRDNDVLQDFYEQFADQLHETQRDKLPELPKRGKLNIEDILSSDFAFA

SEQ ID NO: 69 - protein, 901 aa, Artificial Sequence
  Enterobacteria phage EcoDS1 RNA polymerase + N-terminal His6 tag
MHHHHHHGSSVISIDKHDFSDVSNAIEPFNLLADHYGQDLAVKQLQLEHEAYTEGERRFIKNLERQTERGELADNQVAKPLMQTLVPKIAQAVREWHEGPDGKLSTSRPSVAFTMLSTEEKAVKDRSLRISCESASVIILKVILSKLVKPEGIPITPMASAIGRTLEDEIRFGRIRDKEKEHFKKAIADNLNKRAGASYKKAYMQAVETSMLEQGQLEDAWGTWSPTEAVHVGIKMLEIVIQSTQLVELKRYGAGNAAADVEMVHLSDFWVKKMAQRGFSLAGIAPVYQPCVVPPKPWTGVVGGGYWAKGRRPLPLIRLGSKSAVARYEDVYMPEVYDAVNIIQNTPWKVNKKVLEVVNMVEKLNNTPIDDIPQMEPLKPEDYAGETEEELKAWKKAAAGIYRREKARQSRRLSLSFIVNQANKFSQFKAIWFPYNMDWRGRVYAVPMFNPQGNDMQKGLLTLAVGKPIGADGFKWLKVHGANCAGIDKVTFEERIKWVEDNHDNIMATAKAPMDSIEWWGKLDSPFCFLAFCFEYAGVMHHGLSYSCSLPIAFDGSCSGIQHFSAMLRDHIGGHAVNLTPSGKVQDIYRIVSDRIEEELKVLLVNGTDNEMVTHEDKKTGEITERLKLGTRELARQWLTYGMSRKVTKRSVMTLAYGSKEYGFADQVYEDIVMPAIDSGSGAMFTEPSQASRFMAKMIWEAVSVTVVAAVDAMKWLQGAAKLLAAEVKDKKTGEILKPCLPVHWVTPDGFPVWQEYRKKDTTRLNLMFLGSFNLQPTVNKGTKKELDKHKQESGISPNFVHSQDGSHLRKTVVHTHRKYGVMSFAVIHDSFGTIPADAEYLFRGVRETMVETYRDNDVLLDFYEQFEYQLHESQRDKLPELPKKGKLNIEDILSSDFAFA

SEQ ID NO: 70 - protein, 891 aa, Artificial Sequence
  Morganella phage vB_MmoP_MP2 RNA polymerase + N-terminal His6 tag
MHHHHHHGSSIAAAANKNDFSEIELAAIPFNTLADHYGADLAREQLQLEHESYVMGEERFRKMLERQEKAEEFGDSSVSKPLIITLLPKVSQRVADWVAEWADGSKMGRKPIAWTLLKDIKPDTVAFITIKVVLNKLAGKDEAFMQPLAYAIGSAIEDEARFGRIRELEMAHFKKHAEEQLNKRKGTMYRKAFMSVVEADMLDKGLLGGESWGTWNKTDVMNVGISMLEKLIESTGLVELLPKRHIEEMDRIVIREEYVQLLASRAQTLAGISPMYQPCVVPPKPWVSITGGGYWANGRKPTALIRTHTRKALYRYEDVYMPEVYKAINYAQETPWRVNRKVLAVVNELTKWKNNPVEDMPSIDPLPLPEKPEDIDTNEEALKAWKREAAATYRKDEQRKSRYLSMSFALEQANKFSNKKAIYFPYNMDWRGRVYALPMFNPQGNDMVKGLLTLAKGKPIGKEGFYWLKIHGANCAGVDRVTFPERIKFIEDNHENIMASAEAPLDNLWWTKQDSPFCFLAFCFEYAMVTKKGLGWVCSLPVALDGSCSGIQHFSAMLRDSIGGRAVNLLPSETVQDIYGIVAQKVNEALKEMVINGTDNYTETVTDKSTGEIIERMKLGEKELARQWLEFGVTRSVTKRSVMTLAYGSKEYGFRDQVLEDTIRPAIDSGKGAMFTNPSQAAGFMAKRIWEAVSVTVVAAVGAMKWLQSSAKLLAAEVKDKKTKEVLRKRCAVHWVTPDGFPVWQEYRKPKQKRVHLMFLGSYYDARMKETSSECPIDAHKQESGISPNFVHSQDGNHLRMTVVYAREKYSVESFALIHDSFGTIPADVPNLFKAVRETMVNMYEENDVLADFYEQFADQLHESQLEKMPALPPKGDLNLQDILKSDFAFA

SEQ ID NO: 71 - protein, 891 aa, Artificial Sequence
  Yersinia phage Yepe2 RNA polymerase + N-terminal His6 tag
MHHHHHHGSTNVINAPKNDFSDIANAIQPYNILADHYGAQLAATQLELEHEAHTEGEKRFLKAMERQIKAGEFGDNTVAKPLLSSLAPKFVEAWNTWFTEVEAKRGKRPVAYNLVQKVAPEAAAFITLKVTLACLTKEEFTNLQSVATKIGRSIEDELRFGRIRDEEAKHFKNHVQEALNKRVGIVYKKAFMQAVEGKMLEAGQLHTKWTTWTPEEVIHVGVRMLELLIGSTGLVELHRPFAGNIEKDGEYIQLTEQYVDLLSKRAGALAAIAPMYQPCVVPPKPWTSPVGGGYWAAGRKPLSMVRTGSKKGLERYNDVYMPEVYKAVNIAQNTPWKINKKVLAVVNEIVSWKHCPVADVPAMERGELPVKPVDIDTNEVALKAWKKAASAIYRKEKARVSRRMSMEFMLGQANKFAQFKAIWFPMNMDWRGRVYAVPMFNPQGNDMTKGLLTLAKGKPIGVDGFYWLKIHGANTAGVDKVDFAERIKFIDDNHENIMSVAADPIANTWWTEQDSPFCFLAFCFEYAGVQHHGMNYNCSLPLAFDGSCSGIQHFSAMLRDEVGGRAVNLLPSKEVQDIYRIVAERVNEILNQDVINGTDNEVETLTNKDTGEITEKLKLGTKELAGQWLAYGVTRKVTKRSVMTLAYGSKEYGFRDQVLEDTIQPAIDDGKGLMFTQPNQAAGYMAKLIWNAVTVTVVAAVEAMNWLKSAAKLLAAEVKDKKTKEVLRNRCAVYWVTPDGFPVWQEYRKPVQTRLNLMFLGQIRLQPTVNTNKDSGIDARKQESGIAPNFVHSMDGSHLRMTVVRSYEVYGVESFALIHDSFGTIPADAGNLFKAVRETMVNTYEENDVLADFYDQFADQLHESQLDKMPEMPAKGSLDIQEILKSDFAFA

SEQ ID NO: 72 - protein, 890 aa, Artificial Sequence
  Kluyvera phage Kvp1 RNA polymerase + N-terminal His6 tag
MHHHHHHGSNVINAPKNDFSDIANAIQPYNILADHYGAQLAATQLELEHEAHTEGEKRFLKAMERQIKAGEFGDNAVAKPLLSSLAPKFIEAWNTWFTEVEAKRGKRPVAYNLVQKVAPEAAAFITLKVTLACLTKEEFTNLQSVATKIGRSIEDELRFGRIRDEEAKHFKNHVQEALNKRVGIVYKKAFMQAVEGKMLDAGQLQTKWTTWTPEESIHVGVRMLELLIGSTGLVELHRPFAGNVEKDGEYIQLTEQYVDLLSKRAGALAAIAPMYQPCVVPPKPWTSPVGGGYWAAGRKPLSLVRTGSKKGLERYNDVYMPEVYKAVNIAQNTPWKINKKVLAVVNEIVNWKHCPVEDVPALERGELPVKPEDIDTNEAALKAWKKAASAIYRKEKARVSRRMSMEFMLGQANKFAQFKAIWFPMNMDWRGRVYAVPMFNPQGNDMTKGLLTLAKGKPIGVDGYYWLKIHGANTAGVDKVDFAERIKFIDDNHENIMSVAADPIANTWWAEQDSPFCFLAFCFEYAGVQHHGMNYNCSLPLAFDGSCSGIQHFSAMLRDEVGGRAVNLLPSKEVQDIYRIVAERVNEMLREAVINGTDNEVETVTNKDTGEITEKLKLGTKELAGQWLAYGVTRKVTKRSVMTLAYGSKEYGFRDQVLEDTIQPAIDDGKGLMFTQPNQAAGYMAKLIWESVTVTVVAAVEAMNWLKSAAKLLAAEVKDKKTKEVLRKRCAVHWVTPDGFPVWQEYKKPVQTRLNLMFLGQIRLQPTVNTNKDSGIDARKQESGIAPNFVHSMDGSHLRMTVVRSNEVYGVESFALIHDSFGTIPADAGNLFKAVRETMVNTYEENDVLADFYEQFADQLHESQLDKMPEMPAKGSLDLQEILKSDFAFA

SEQ ID NO: 73 - protein, 914 aa, Artificial Sequence
  Klebsiella phage K11 RNA polymerase + N-terminal His6 tag
MHHHHHHGSNALNIARNDFSEIELAAIPYNILSEHYGDKLAREQLALEHEAYELGEQRFLKMLERQVKAGEFADNAAAKPLVLTLHPQLTKRIDDWKEEQANARGKKPRAYYPIKHGVASKLAVSMGAEVLKEKRGVSSEAIALLTIKVVLGTLTDASKATIQQVSSQLGKALEDEARFGRIREQEAAYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVETVGGGYWSVGRRPLALVRTHSKKALRRYADVHMPEVYKAVNLAQNTPWKVNKKVLAVVNEIVNWKHCPVGDVPAIEREELPPRPDDIDTNEVARKAWRKEAAAVYRKDKARQSRRLSMEFMVAQANKFANHKAIWFPYNMDWRGRVYAVSMFNPQGNDMTKGMLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFHEKVTLGESVLAAQWLQYGVTRKVTKRSVMTLAYGSKEFGFRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSFGTIPADAGNLFKAVRETMVKTYEDNDVIADFYDQFADQLHESQLDKMPAVPAKGDLNLRDILESDFAFA

SEQ ID NO: 74 - protein, 914 aa, Artificial Sequence
  Klebsiella phage KP32 RNA polymerase + N-terminal His6 tag
MHHHHHHGSNALNIARNDFSEIELAAIPYNILSEHYGDKLAREQLALEHEAYELGEQRFLKMLERQVKAGEFADNVAAKPLVLTLHPQLTKRIDDWKEEQANARGKKPRAYYPIKHGVASELALSMGAEVLNEKRGVSSEAIALLTIKVVLGTLTDASKATIQQVSSQLGKALEDEARFGRIREQEATYFKKNVADQLDKRVGHVYKKAFMQVVEADMISKGMLGGDNWSSWKTDEQMHVGTKLLELLIEGTGLVEMTKNKMADGSDDVTSMQMVQLAPAFVELLSKRAGALAGISPMYQPCVVPPKPWVETVGGGYWSVGRRPLALVRTHSKKALRRYADVHMPEVYKAVNLAQNTPWKVNKKVLAVVNEIINWKHCPVGDVPAIEREELPPRPDDIDTNEVARKAWRKEAAAVYRKDKARQSRRLSMEFMVAQANKFANHKAIWFPYNMDWRGRVYAVSMFNPQGNDMTKGMLTLAKGKPIGLDGFYWLKIHGANCAGVDKVPFPERIKFIEENEGNILASAADPLNNTWWTTQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFREKVTLGESVLAAQWLQYGVTRKVTKRSVMTLAYGSKEFGFRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSFGTIPADAGNLFKAVRETMVKTYEDNDVIADFYDQFADQLHESQLDKMPAAPAKGDLNLRDILESDFAFA

SEQ ID NO: 75 - protein, 914 aa, Artificial Sequence
  Klebsiella phage vB_KpnP_KpV766 RNA polymerase + N-terminal His6 tag
MHHHHHHGSNALNIARNDFSEIELAAIPYNILSEHYGDKLAREQLALEHEAYELGEQRFLKMLERQVKAGEFADNVAAKPLVLTLHPQLTKRIDDWKEEQANARGKKPRAYYPIKHGVASELAISMGAEVLNEKRGVSSEAIALLTIKVVLGTLTDASKATIQQVSSQLGKALEDEARFGRIREQEATYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVGTVGGGYWSVGRRPLALVRTHSKKALRRYEDVHMPEVYKAVNIAQNTPWKVNKKVLAVVNEIVNWKHCPVADVPAIEREELPPRPDDIDTNEVSRKAWRKEAAAVYRKDKARQSRRLSMEFMVAQANKFANHKAIWFPYNMDWRGRVYAVSMLNPQGNDMTKGMLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFREKVTLGESVLAAQWLQYGVTRKVTKRSVMTLAYGSKEFGFRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYHKRDQARLKLTFLGQANVFMTYNKGDTKEIDAHKQESGIAPNFVHSQDGSHLRMTVVHANEVYGIDSFALIHDSFGTIPADAGNLFKAVRETMVKTYEDNDVIADFYDQFADQLHESQLDKMPEVPAKGDLNLHDILESDFAFA

SEQ ID NO: 76 - protein, 892 aa, Artificial Sequence
  Enterobacteria phage T3 RNA polymerase + N-terminal His6 tag
MHHHHHHGSNIIENIEKNDFSEIELAAIPFNTLADHYGSALAKEQLALEHESYELGERRFLKMLERQAKAGEIADNAAAKPLLATLLPKLTTRIVEWLEEYASKKGRKPSAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVAITGGGYWANGRRPLALVRTHSKKGLMRYEDVYMPEVYKAVNLAQNTAWKINKKVLAVVNEIVNWKNCPVADIPSLERQELPPKPDDIDTNEAALKEWKKAAAGIYRLDKARVSRRISLEFMLEQANKFASKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVTHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVITYENNDVLADFYSQFADQLHETQLDKMPPLPKKGNLNLQDILKSDFAFA

SEQ ID NO: 77 - protein, 892 aa, Artificial Sequence
  Serratia phage SM9-3Y RNA polymerase + N-terminal His6 tag
MHHHHHHGSNIIETIEKNDFSEIELAAIPFNTLADHYGSSLAREQLALEHESYELGERRFLKMLERQAKAGEIADNAAAKPLLATLLPKLTARIVEWLEEYASKKGRKPVAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVSITGGGYWANGRRPLALIRTHSKKGLMRYEDVYMPEVYKAVNIAQNTAWKINKKVLAVVNEIVNWKNCPVADIPSLERQELPPKPEDIDTNEAALKEWKKAAAGIYRLDKARVSRRISLEFMLEQANKFANKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVAHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVLTYENNDVLADFYDQFADQLHETQLDKMPPLPKKGNLNLQDILKSDFAFA

SEQ ID NO: 78 - protein, 891 aa, Artificial Sequence
  Yersinia phage YpP-R RNA polymerase + N-terminal His6 tag
MHHHHHHGSNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVNLHRQNAGVVGQDSETIELTPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDTNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEDNHENIMACAKSPLENTWWAEQDSPFCFLAFCFEYAGVQHHGLSYNCSLPLAFDGSCSGIQHFSAMLLDEVGGLAVNLLPSATVQDIYGIVAKKVNVILQADVINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWEAVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLQDILKSDFAFA

SEQ ID NO: 79 - protein, 885 aa, Artificial Sequence
  Pectobacterium phage PP99 RNA polymerase + N-terminal His6 tag
MHHHHHHGSYTSDELYQKQLELEGEMHGYGVTRFDRNNQRAIDSGTPSDTDWNRRLLSNFIEPMVKGINAYKGYYKTKAGRPTVALKYIRQVQPEQAAYIAIKNILDVLGSTTFDANWLVTTIGRRIEDQVRFTKLEEAAPKYVGKVKDSLAKRNSLQYAHQHKVLVATEKKLAENPDRAQLELPRWQEWAEEDCKHVGSLLVNIFEQCILFEGEPVIRKEVQTVRKGTLVFIKPTEKVTKWIHEFREAIGGLAPAYAPCVVPPLDWTSPFTGGFHTEAVSSTLHLAKVRNKRHLRKLTKEQMPAVYKAVNNLQKVRWRISERVLATANTLVELGLPYALPSKDESDWKEKNPCPVPEYLQDLRGEQLKAALTASQWEAFQEWKQLARQNYDEESERVASFREVVRTLGQANRYVGFDAIYFVYTLDFRGRVYCQSSLVSPQGGDLQKALIKFADGMKLGERGEYWFKVHGANEWGWDKKEFDERVALVSEPEFCEMCLDIASDPVTFNDWIKADKPWQFLNWCFEYADFLKHVQSDGNPQDFVSYIPCAMDGSCSGIQHYSAMLRDTVGGTAVNLVNSDKPNDIYGEVCKVSIKELQAIADGSQAYDGKIDPILAQQLAQEWLRLQPNRSLTKKPVMTLPYGSTQLTCREHVSQWLKDLQKEENKRAKAEFREPMKVHAFGDADSAMPLKFAESLMTSIVWHSIGKVVVAARAGMAYIKAVTSSVAKMNMPLEWTTPTGFIVRQEIYQFTTRQVNTQLLGGTKFVVSTKSKDIDYHRMINSCAPNFVHSMDASHLTLATNYFADAGISSIAVIHDSFGTHAGATDLLRERLRASMVDMYEQHDVITNFLAETEGRLMTAFEHIRVPERGELQLDSINQSTYAFA

SEQ ID NO: 80 - protein, 824 aa, Artificial Sequence
  Aeromonas phage 25AhydR2PP RNA polymerase + N-terminal His6 tag
MHHHHHHGSATLQDQLEWETYQRDLGRTKLEQQLRKAEEKGRIAETPLGSSVLRRYVLWMSERLSKDITEDLGKAGRSKAYSPLLHALDPDAVSLLAITTLIELVCARKEGFIHLGFLASEIGRRVYGELALASFRDINPELYEALTKDLQKKMSQDLRHKLTVFRMQAQKAGIELPEWTPSQKAQVGSYLVSLMEKQSGDPKYLCELDSVATGHKSAYVVYLSQHVQELMAEIEDRMMLKAGFAAPCLIPPQPWDADGTQGGFYGDLKVRAVRFFKGSSEQWEIMRTEGHDPTVVLGMLDAVQHVAWKVNPFILDLIKKMRAKGLETKTVRTTAALPKPERPLFLDLQDGALTPEQEELKKQWKRQMRDWHTEIRKVSRIEARLGVALAAAEEMSKHDRFYFAHQVCDRFRMYPVSGPLSPQGADNQKALLHSADGGPIDSNEALYWFKLNIAAKFGIDKLSPEECIKWVDDNETSIISAASDPTSRDAFYWWSQADKPLQFIAVCDELRSYKLDPANFVARIACAMDGTCNGLQNYSALLRDEVGGRATNLISTSDGVPADIYGDVARASWLRLLESDECPFRTSWMAHGFNRKLTKPSVMTQVYGSTYGTCRKSILSYCIENELFDGEEYPHSDYAGKLVWAGIDDVVVKAKEAMKWLRESAGAVMREGAQYITWIAPSGARVVQIYNKFDELRVWTHVGNKIRLQLKGPEHPDKPDKMRHRNAFPPNFIHSVDASHMALVAVRMVKEFGLGVFLHFIHDDFGALPHQAATLAGVIREEFVRMHQSYSLEHIREQYPFLSVPPKRGNLDINCVLDSVNFFR

SEQ ID NO: 81 - protein, 891 aa, Artificial Sequence
  Stenotrophomonas phage IME15 RNA polymerase + N-terminal His6 tag
MHHHHHHGSTVIAIEKNDFSDVELAVIPFNTLADHYGEKLAREQLALEHEAYEMGEARFRKIFERQLKAGEVADNAAAKPLVATLLPKMIERIHAWFEEVSAKRGKRPTAFKFLQEVKPEAIAYITIKTVLGTLTSAEQTTVQAAASAVGRAIEDEARFGRIRDLEAKHFKKNVEEQLNKRVGHVYKKAFLQVVEADMLSKGLMGGEAWSSWHKEDSIHVGVRCIEMLIEATGLVVLERQNAGVVGADAETLSLASEYADAIATRAGALAGISPMYQPCVVPPKPWTTVTGGGYWANGRRPLALVRTHGKKALMRYEDVYMPEVYKAVNLAQSTAWKINKKVLAVANEITKWKHCPVEDIPAIEREELPVKPDDIDENPEALTNWKRAAAAVYRKDKARKSRRLSLEFMLEQANKFANHKAIWFPYNMDWRGRVYAVSMFNPQGNDMTKGLLTLAKGKAIGKEGFYWLKIHGANCAGVDKVPFPERIKFIEDNHEHIMASAKNPLEYTWWAEQDSPFCFLAFCFEYAGVMHHGLSYNCSLPLAFDGSCSGIQHFSAMLRDEVGGRAVNLLPSETVQDIYGIVAKKVNEIMQRDVISGTDDELVTETDKTTGEITEKAVLGTRTLAGQWLAYGANRSVTKRSVMTLAYGSKEFGFRQQVLEDTIRPAIDSGKGLMFTIPNQAAGYMAKLIWDSVSVTVVAAVEAMKWLQSAAKLLAAEVKDKKTGEVLRNRCAVHWVTPDGFPVWQEYRKPLQTRLNLMFLGQFRLQPTINTNKDSGIDAHKQESGIAPNFVHSQDGSHLRKTVVWAHEKYGIESFALIHDSFGTIPADAGNLFKAVRETMVDTYENCDVLADFYEQFADQLHESQLDKMPALPKKGNLNLRDILESDFAFA

SEQ ID NO: 82 - protein, 891 aa, Artificial Sequence
  Escherichia phage T7 RNA polymerase + N-terminal His6 tag
MHHHHHHGSNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 83 - DNA, 15 bp, Yersinia phage phiR8-01
tcgaccctattaaac

SEQ ID NO: 84 - DNA, 18 bp, Aeromonas phage phiAS7
ttgattcggtacgcctaa

SEQ ID NO: 85 - DNA, 16 bp, Aquamicrobium phage P14
tttcggtactctcttg

SEQ ID NO: 86 - DNA, 18 bp, Caulobacter phage Percy
acattctcgctacaccaa

SEQ ID NO: 87 - DNA, 14 bp, Xanthomonas phage f30-Xaj
ttggtacacctata

SEQ ID NO: 88 - DNA, 21 bp, Burkholderia phage Bp-AMP4
tttcggtcgccttaccgacac

SEQ ID NO: 89 - DNA, 16 bp, Pseudomonas phage Bf7
taattgggccactata

SEQ ID NO: 90 - DNA, 14 bp, Pseudomonas phage Andromeda
ccactatagcaaca

SEQ ID NO: 91 - DNA, 15 bp, Cyanophage Syn5
attgggcacccgtaa

SEQ ID NO: 92 - DNA, 28 bp, Pantoea phage LIMEzero
cccatgcatagccgtgggcagtagggca

SEQ ID NO: 93 - DNA, 17 bp, Acinetobacter phage Petty
aatttagaagggacact

SEQ ID NO: 94 - DNA, 20 bp, Pantoea phage LIMElight
tgacgttatagagagacaac

SEQ ID NO: 95 - DNA, 15 bp, Erwinia amylovora phage Era103
taaccacccagtata

SEQ ID NO: 96 - DNA, 18 bp, Proteus phage vB_PmiP_Pm5460
taattagagaccactata

SEQ ID NO: 97 - DNA, 15 bp, Proteus phage PM 93
ttaaagaccactata

SEQ ID NO: 98 - DNA, 17 bp, Salmonella virus SP6
atttaggtgacactata

SEQ ID NO: 99 - DNA, 17 bp, Lelliottia phage phD2B
aattaggggctactata

SEQ ID NO: 100 - DNA, 14 bp, Escherichia phage ECBP5
taggcactacaata

SEQ ID NO: 101 - DNA, 16 bp, Delftia phage IME-DE1
gttagcccacaccatt

SEQ ID NO: 102 - DNA, 14 bp, Pseudomonas phage phi15
aaccccacacaata

SEQ ID NO: 103 - DNA, 19 bp, Vibrio phage VP3
tcaattaaccctgactata

SEQ ID NO: 104 - DNA, 17 bp, Vibriophage VP4
aattaaccctgactata

SEQ ID NO: 105 - DNA, 15 bp, Vibrio phage ICP3_2008_A
ttaacccacactata

SEQ ID NO: 106 - DNA, 15 bp, Vibrio phage ICP3_2007_A
ttaacccacactata

SEQ ID NO: 107 - DNA, 17 bp, Vibrio phage N4
aattaacccacactata

SEQ ID NO: 108 - DNA, 15 bp, Cronobacter phage Dev2
ttaactatcactata

SEQ ID NO: 109 - DNA, 14 bp, Escherichia phage vB_EcoP_GA2A
taactatcactata

SEQ ID NO: 110 - DNA, 14 bp, Enterobacteria phage EcoDS1
aaactatcactata

SEQ ID NO: 111 - DNA, 17 bp, Morganella phage vB_MmoP_MP2
acatttgtggcactata

SEQ ID NO: 112 - DNA, 16 bp, Yersinia phage Yepe2
aatacgactcactatt

SEQ ID NO: 113 - DNA, 16 bp, Kluyvera phage Kvp1
aatacgactcactatt

SEQ ID NO: 114 - DNA, 17 bp, Klebsiella phage K11
aattagggcacactata

SEQ ID NO: 115 - DNA, 17 bp, Klebsiella phage KP32
attagggcacactatag

SEQ ID NO: 116 - DNA, 15 bp, Klebsiella phage vB_KpnP_KpV766
ttaggtagcactata

SEQ ID NO: 117 - DNA, 20 bp, Enterobacteria phage T3
aattaaccctcactaaaggg

SEQ ID NO: 118 - DNA, 21 bp, Serratia phage SM9-3Y
ttaaccctcactaacgggaga

SEQ ID NO: 119 - DNA, 18 bp, Yersinia phage YpP-R
ttaatacgactcactata

SEQ ID NO: 120 - DNA, 12 bp, Pectobacterium phage PP99
gaaactacaata

SEQ ID NO: 121 - DNA, 25 bp, Aeromonas phage 25AhydR2PP
gattcggtacgcctaagagaagaca

SEQ ID NO: 122 - DNA, 24 bp, Stenotrophomonas phage IME15
ttaatacgactcactatagggaga

SEQ ID NO: 123 - DNA, 18 bp, Escherichia phage T7
ttaatacgactcactata

SEQ ID NO: 124 - DNA, 1824 bp, Artificial Sequence
  In vitro transcription template for Yersinia phage phiR8-01 RNA polymerase
actacctgattatcgaccctattaaacaaggagccaattaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 125 - DNA, 1832 bp, Artificial Sequence
  In vitro transcription template for Aeromonas phage phiAS7 RNA polymerase
ccagggacggttgattcggtacgcctaagagaagacaacgaaccaataagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 126 - DNA, 1824 bp, Artificial Sequence
  In vitro transcription template for Aquamicrobium phage P14 RNA polymerase
agggagtgcctttcggtactctcttgcaacgaactcataaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 127 - DNA, 1826 bp, Artificial Sequence
  In vitro transcription template for Caulobacter phage Percy RNA polymerase
tgtagttttagtacattctcgctacaccaatcatgcaaggaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 128 - DNA, 1821 bp, Artificial Sequence
  In vitro transcription template for Xanthomonas phage f30-Xaj RNA polymerase
gtgccggacctttttggtacacctatagcacagaggaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 129 - DNA, 1823 bp, Artificial Sequence
  In vitro transcription template for Burkholderia phage Bp-AMP4 RNA polymerase
gcttccccgatttcggtcgccttaccgacacaatcaagaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 130 - DNA, 1822 bp, Artificial Sequence
  In vitro transcription template for Pseudomonas phage Bf7 RNA polymerase
tcaattctaattgggccactatagcaacaccaaaaccaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 131 - DNA, 1827 bp, Artificial Sequence
  In vitro transcription template for Pseudomonas phage Andromeda RNA polymerase
attctaattgggccactatagcaacaccaaaaccatcatcggaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 132 - DNA, 1833 bp, Artificial Sequence
  In vitro transcription template for Cyanophage Syn5 RNA polymerase
gattcgtaaaacgggtccattgggcacccgtaagcaaggagacataccaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 133 - DNA, 1834 bp, Artificial Sequence
  In vitro transcription template for Pantoea phage LIMEzero RNA polymerase
tttctgtctgcccatgcatagccgtgggcagtagggcaattatgccataaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 134 - DNA, 1842 bp, Artificial Sequence
  In vitro transcription template for Acinetobacter phage Petty RNA polymerase
ctggttgatttaatgtaagtaatttagaagggacactacatagaataaaagcataataagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 135 - DNA, 1821 bp, Artificial Sequence
  In vitro transcription template for Pantoea phage LIMElight RNA polymerase
cagattaaagagtgacgttatagagagacaacaactaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 136 - DNA, 1840 bp, Artificial Sequence
  In vitro transcription template for Erwinia amylovora phage Era103 RNA polymerase
gtggcattaaccacccagtatagaaggaagcacaatttcaatttggcatgaccgcaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 137 - DNA, 1838 bp, Artificial Sequence
  In vitro transcription template for Proteus phage vB_PmiP_Pm5460 RNA polymerase
tggtcttaattagagaccactatagaagagataaattttaatggcaattcagcaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 138 - DNA, 1831 bp, Artificial Sequence
  In vitro transcription template for Proteus phage PM 93 RNA polymerase
ttcttaattaaagaccactatagaagggagaagtcactcccttttgaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 139 - DNA, 1819 bp, Artificial Sequence
  In vitro transcription template for Salmonella virus SP6 RNA polymerase
ttaattgcctatttaggtgacactatagaagggaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 140 - DNA, 1830 bp, Artificial Sequence
  In vitro transcription template for Lelliottia phage phD2B RNA polymerase
cccggtaattaggggctactatagaagagagaaacatttacggcgaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 141 - DNA, 1819 bp, Artificial Sequence
  In vitro transcription template for Escherichia phage ECBP5 RNA polymerase
cttaataattaggcactacaataggagaagctgaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 142 - DNA, 1841 bp, Artificial Sequence
  In vitro transcription template for Delftia phage IME-DE1 RNA polymerase
aggctgagttagcccacaccattgagagaacctccggcatcccgctggagggctctaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 143 - DNA, 1820 bp, Artificial Sequence
  In vitro transcription template for Pseudomonas phage phi15 RNA polymerase
aattaaaaccccacacaatagacagacagcctcctaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 144 - DNA, 1822 bp, Artificial Sequence
  In vitro transcription template for Vibrio phage VP3 RNA polymerase
aacacatcaattaaccctgactatagggctacttccaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 145 - DNA, 1824 bp, Artificial Sequence
  In vitro transcription template for Vibriophage VP4 RNA polymerase
cttgattaattaaccctgactatagggagagaggggcgtaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 146 - DNA, 1835 bp, Artificial Sequence
  In vitro transcription template for Vibrio phage ICP3_2008_A RNA polymerase
ttgattaattaacccacactatagggagagaggggcgtaaagttcctctcaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 147 - DNA, 1835 bp, Artificial Sequence; identical to SEQ ID NO: 146
  In vitro transcription template for Vibrio phage ICP3_2007_A RNA polymerase

SEQ ID NO: 148 - DNA, 1832 bp, Artificial Sequence
  In vitro transcription template for Vibrio phage N4 RNA polymerase
cctaacttaattaacccacactatagggctacttccaacaaccacataagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 149 - DNA, 1826 bp, Artificial Sequence
  In vitro transcription template for Cronobacter phage Dev2 RNA polymerase
caccttaactatcactatagggactataggccctttaagttaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 150 - DNA, 1835 bp, Artificial Sequence
  In vitro transcription template for Escherichia phage vB_EcoP_GA2A RNA polymerase
ctgacttaactatcactataggactctgggtctaagactacaagtgaaagaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 151 - DNA, 1829 bp, Artificial Sequence
  In vitro transcription template for Enterobacteria phage EcoDS1 RNA polymerase
aacactaaactatcactatagggactttaggacctaagatatgaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 152 - DNA, 1826 bp, Artificial Sequence
  In vitro transcription template for Morganella phage vB_MmoP_MP2 RNA polymerase
gaacacatttgtggcactatagggaaacacacgcaactcgaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 153 - DNA, 1832 bp, Artificial Sequence
  In vitro transcription template for Yersinia phage Yepe2 RNA polymerase
ttaaattaatacgactcactattggagaggggtgcctatatgataccaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 154 - DNA, 1827 bp, Artificial Sequence
  In vitro transcription template for Kluyvera phage Kvp1 RNA polymerase
taagtgaacaatacgactcactattgggaaggggtttatactaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 155 - DNA, 1835 bp, Artificial Sequence
  In vitro transcription template for Klebsiella phage K11 RNA polymerase
tcaggcaattagggcacactatagggaaccttcgaatgaccgagggttccaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 156 - DNA, 1825 bp, Artificial Sequence
  In vitro transcription template for Klebsiella phage KP32 RNA polymerase
tgctcaattagggcacactatagggagacaacactaagagaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 157 - DNA, 1827 bp, Artificial Sequence
  In vitro transcription template for Klebsiella phage vB_KpnP_KpV766 RNA polymerase
ggcactaattaggtagcactatagggaagtgcccattatgataagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 158 - DNA, 1816 bp, Artificial Sequence
  In vitro transcription template for Enterobacteria phage T3 RNA polymerase
cggtgaattaaccctcactaaagggagacacaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 159 - DNA, 1823 bp, Artificial Sequence
  In vitro transcription template for Serratia phage SM9-3Y RNA polymerase
tagcattaaccctcactaacgggagactacttaaggtcaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 160 - DNA, 1825 bp, Artificial Sequence
  In vitro transcription template for Yersinia phage YpP-R RNA polymerase
ggtaaattaatacgactcactatagggagaaggtaatccgaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 161 - DNA, 1815 bp, Artificial Sequence
  In vitro transcription template for Pectobacterium phage PP99 RNA polymerase
taagttagaaactacaataggactaacaacaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 162 - DNA, 1826 bp, Artificial Sequence
  In vitro transcription template for Aeromonas phage 25AhydR2PP RNA polymerase
ctcgcggaatctgattcggtacgcctaagagaagacaacgaaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 163 - DNA, 1828 bp, Artificial Sequence
  In vitro transcription template for Stenotrophomonas phage IME15 RNA polymerase
ggtcaagattaatacgactcactatagggagaacaatacgactaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 164 - DNA, 1845 bp, Artificial Sequence
  In vitro transcription template for Escherichia phage T7 RNA polymerase
atcgagatctcgatcccgcgaaattaatacgactcactatagggagaccacaacggtttcaagaaggagatatcaccatggaggatgccaagaacatcaagaaaggcccagccccattttaccccttggaggatggcactgctggtgaacagctccacaaagcgatgaagcgctacgccttggtgccgggtaccattgcgtttacagacgcccacatcgaggtgaacataacctatgccgagtacttcgaaatgtcggttcggttggcggaggcaatgaagaggtatggcctgaacaccaaccaccgcattgtcgtgtgttcggagaattccctgcaattctttatgcctgtgcttggtgccttgttcatcggcgttgccgttgcacccgctaatgacatatacaacgagagggagctcctgaactcgatgaacatatcccaaccgacggttgtctttgtctccaagaagggacttcagaagatcctgaatgtgcagaagaagctgccaatcattcagaagatcatcatcatggactctaagaccgactaccagggcttccaatccatgtacaccttcgtgacctcacacttgccacccggattcaacgagtacgacttcgttcctgagtccttcgaccgcgataagaccatagcgctgatcatgaatagctctggcagcaccggactgccaaagggtgtggctcttccgcatagaacagcgtgcgttcgtttcagtcatgcacgggacccgattttcgggaaccagatcatacccgatacggccatcctctcagtggtcccatttcaccacgggttcggcatgtttaccactctggggtacctgatctgcgggtttcgcgtggtcctgatgtaccgttttgaggaggaactgttcctgaggagccttcaggactacaagatccaaagtgccttgctcgtgccaacactcttcagtttcttcgcgaaatccacgctgatcgacaagtatgacctgtcaaacctgcacgagatcgcctctggaggggctcctctcagcaaagaggtgggcgaagcagtggccaaacgctttcatctgcccggaatcaggcaagggtatggcctcacggagactaccagcgcgattctcatcacaccggaaggagatgacaagcctggcgccgtcggtaaagtcgtgcccttcttcgaagcaaaggtggtggatctcgataccggcaagaccctcggcgtcaaccagagaggggaactgtgcgtcagaggtcctatgatcatgagcggatacgtgaacaatcccgaggccactaatgccctgatcgacaaagatgggtggcttcattccggcgacattgcctactgggacgaggacgagcacttcttcatagttgaccggctgaagtctctgatcaagtacaaaggctatcaggtcgctcctgccgaactggagagcattctcctgcagcaccccaacatcttcgatgcaggtgtggcggggcttccggacgacgatgctggagaactgccagcagctgtggtcgttctcgaacatgggaaaacgatgacggagaaagagatcgtggactatgtggccagccaagtgactacagcgaagaagctgaggggcggagtcgtctttgtggacgaggtgcccaaagggctgacaggcaagctcgatgctcgcaagattcgggaaattctcattaaggccaagaaaggcggcaagtcaaagctgtgacacgtgaggatccaactcgagaacttagatggtattagtgacctgtaacagagcattagcgcaaggtgatttttgtcttcttgcgctaattttttgtcatcaaacctgtcgctag

SEQ ID NO: 165 - protein, 8 aa, Artificial Sequence
  FLAG tag epitope tag
DYKDDDDK

SEQ ID NO: 166 - protein, 15 aa, Artificial Sequence
  AviTag epitope tag
GLNDIFEAQKIEWHE

SEQ ID NO: 167 - protein, 26 aa, Artificial Sequence
  Calmodulin tag epitope tag
KRRWKKNFIAVSAANRFKKISSSGAL

SEQ ID NO: 168 - protein, 13 aa, Artificial Sequence
  E-tag epitope tag
GAPVPYPDPLEPR

SEQ ID NO: 169 - protein, 9 aa, Artificial Sequence
  HA-tag epitope tag
YPYDVPDYA

SEQ ID NO: 170 - protein, 10 aa, Artificial Sequence
  Myc-tag epitope tag
EQKLISEEDL

SEQ ID NO: 171 - protein, 18 aa, Artificial Sequence
  N-tag epitope tag
TKENPRSNQEESYDDNES

SEQ ID NO: 172 - protein, 15 aa, Artificial Sequence
  S-tag epitope tag
KETAAAKFERQHMDS

SEQ ID NO: 173 - protein, 38 aa, Artificial Sequence
  SBP-tag epitope tag
MDEKTTGWRGGHVVEGLAGELEQLRARLEHHPQGQREP

SEQ ID NO: 174 - protein, 12 aa, Artificial Sequence
  Spot-tag epitope tag
PDRVRAVSHWSS

SEQ ID NO: 175 - protein, 8 aa, Artificial Sequence
  Strep-tag epitope tag
WSHPQFEK

SEQ ID NO: 176 - protein, 10 aa, Artificial Sequence
  Ty-tag epitope tag
EVHTNQDPLD

SEQ ID NO: 177 - protein, 14 aa, Artificial Sequence
  V5-tag epitope tag
GKPIPNPLLGLDST

SEQ ID NO: 178 - protein, 11 aa, Artificial Sequence
  VSV-tag epitope tag
YTDIEMNRLGK

SEQ ID NO: 179 - protein, 8 aa, Artificial Sequence
  XPress tag epitope tag
DLYDDDDK

SEQ ID NO: 180 - protein, 16 aa, Artificial Sequence
  Linker peptide 1
GGGGSGGSGGSGGGGS

SEQ ID NO: 181 - protein, 12 aa, Artificial Sequence
  Linker peptide 2
SGGSSAAGSGSG

SEQ ID NO: 182 - protein, 12 aa, Artificial Sequence
  Linker peptide 3
SAGSSAAGSGSG

SEQ ID NO: 183 - protein, 6 aa, Artificial Sequence
  Polyglutamate tag epitope tag
EEEEEE

SEQ ID NO: 184 - protein, 14 aa, Artificial Sequence
  Alph-helical linker
AEAAAAKEAAAAKA

SEQ ID NO: 185 - protein, 20 aa, Artificial Sequence
  Alph-helical linker
AEAAAAKEAAAAKEAAAAKA

SEQ ID NO: 186 - protein, 26 aa, Artificial Sequence
  Alph-helical linker
AEAAAAKEAAAAKEAAAAKEAAAAKA

SEQ ID NO: 187 - protein, 32 aa, Artificial Sequence
  Alph-helical linker
AEAAAAKEAAAAKEAAAAKEAAAAKEAAAAKA

We claim:

1. A method of performing in vitro transcription comprising the steps of (a) combining (i) a polypeptide having at least 95% amino acid sequence identity to a single-subunit RNA polymerase (RNApol) molecule selected from the group consisting of SEQ ID NOs: 21-25, and 62-66, (ii) a double-stranded DNA template comprising a promoter selected from the group consisting of SEQ ID NOs: 103-107 operatively linked to a polynucleotide encoding a protein or polypeptide; and (iii) one or more nucleotide triphosphates;

(b) incubating the combination of (a) at a temperature from 10° C. to 80° C.; and (c) producing a transcript or a population of transcripts.

2. The method according to claim 1, wherein at least one of the nucleotide triphosphates is a modified nucleotide triphosphate.

3. The method according to claim 1, wherein the temperature is 10° C. to 50° C.

4. The method according to claim 1, wherein the RNApol produces a population of transcripts that is highly uniform in length.

5. The method according to claim 1, wherein the transcript or population of transcripts is at least 1 kb in length.

6. The method according to claim 1, wherein the single subunit RNApol produces a transcript yield that is greater than that produced by T7 RNApol under the same in vitro transcription conditions.

7. The method according to claim 1, wherein when using modified nucleic acids the single subunit RNApol produces a transcript yield that is greater than that produced by T7 RNApol under the same in vitro transcription conditions.

8. The method according to claim 1, wherein a transcript or population of transcripts produced by the single subunit RNApol has less double-stranded RNA than that for transcripts produced with T7 RNApol under the same in vitro transcription conditions.

9. The method according to claim 1, wherein the transcript or population of transcripts produced by the single subunit RNApol has a translational capacity that is greater than that for transcripts produced with T7 RNApol under the same in vitro transcription conditions.

* * * * *